United States Patent 11,446,398 (REGULATED BIOCIRCUIT SYSTEMS) - sequence listing, part 92

SEQ ID NO: 200482 - DNA, 2505 bp, Homo sapiens
  Payload ID: 19559
  Gene Name: X-ray radiation resistance associated 1
  Uniprot ID: Q6P2D8
  ENST ID: ENST00000527087
  CDS Start-End: 262-2058
gtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaa

SEQ ID NO: 200483 - DNA, 2339 bp, Homo sapiens
  Payload ID: 19559
  Gene Name: X-ray radiation resistance associated 1
  ENST ID: ENST00000530562
  CDS Start-End: 1101-1826
gtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagttcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtgctgtcctgcaccagtggacagaacggcggctggtgaaccacaagcagtacctggaggccaagaggctgttgaaggagttccaggcacgttaccggcagctgagtctcaatatgttgcccaggctggtctcaaactcctgagctcaaatgatcctcctgcctcccaaagtgctgttatcacaggagtcaaccactatgcccggcttcctaataatttttactgctgctctcaaagtttttgacaacgcacttgtgttgctggcaaacaacattttcaccgcaatgctgagccactgctaacagaccattagctaaaaatttacaaaagtgaaaaaaatcatgtatccatttaaatattcaaatgaatcatgttggtgttttctcaatatggagttctgtacaagtttttgtttctttgttttcattgcttttggttgttatttataaggatttgagaacttggtctctagaagagagtttttatactgaaaaagactaagggagggtgagaaagtagcattttaaatgtgaataaaaaatatcaattgct

SEQ ID NO: 200484 - DNA, 986 bp, Homo sapiens
  Payload ID: 19559
  Gene Name: X-ray radiation resistance associated 1
  ENST ID: ENST00000525407
  CDS Start-End: 98-986
cgagatccccggggggctcgcaggcgcgcatccctcctgactgggacgtcgcctccgcagacccctcggaggctgaagcgacgccggaggcagggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaa

SEQ ID NO: 200485 - DNA, 2802 bp, Homo sapiens
  Payload ID: 19560
  Gene Name: X-ray repair complementing defective repair in Chinese hamster cells 1
  Uniprot ID: P18887
  ENST ID: ENST00000262887
  CDS Start-End: 549-2450
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccagaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtagagaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctca

SEQ ID NO: 200486 - DNA, 1994 bp, Homo sapiens
  Payload ID: 19560
  Gene Name: X-ray repair complementing defective repair in Chinese hamster cells 1
  ENST ID: ENST00000543982
  CDS Start-End: 106-1914
actttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccagaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctc

SEQ ID NO: 200487 - DNA, 913 bp, Homo sapiens
  Payload ID: 19560
  Gene Name: X-ray repair complementing defective repair in Chinese hamster cells 1
  ENST ID: ENST00000598165
  CDS Start-End: 38-913
tcccagcaacaggcatcctcctctctcagatcctgccatggtcactcctcagacctcccaacgagggtctcttgctgcccctcttggctattttcaggtcttgtttaagactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagcc

SEQ ID NO: 200488 - DNA, 809 bp, Homo sapiens
  Payload ID: 19560
  Gene Name: X-ray repair complementing defective repair in Chinese hamster cells 1
  ENST ID: ENST00000597811
  CDS Start-End: 1-496
gggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccagag

SEQ ID NO: 200489 - DNA, 586 bp, Homo sapiens
  Payload ID: 19560
  Gene Name: X-ray repair complementing defective repair in Chinese hamster cells 1
  ENST ID: ENST00000594107
  CDS Start-End: 70-586
actctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggaccta

SEQ ID NO: 200490 - DNA, 628 bp, Homo sapiens
  Payload ID: 19560
  Gene Name: X-ray repair complementing defective repair in Chinese hamster cells 1
  ENST ID: ENST00000599693
  CDS Start-End: 1-628
ggtcactcctcagacctcccaacgagggtctcttgctgcccctcttggctattttcaggtcttgtttaagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagc

SEQ ID NO: 200491 - DNA, 3067 bp, Homo sapiens
  Payload ID: 19561
  Gene Name: X-ray repair complementing defective repair in Chinese hamster cells 2
  Uniprot ID: O43543
  ENST ID: ENST00000359321
  CDS Start-End: 87-929
tttgactggccgtagagtctgcgcagttggtgaatggcgttggtggcgggaaagttgagtctctcctgcgccgagccttcggggcgatgtgtagtgccttccatagggctgagtctgggaccgagctccttgcccgacttgaaggtagaagttccttgaaagaaatagaaccaaatctgtttgctgatgaagattcacctgtgcatggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctct

SEQ ID NO: 200492 - DNA, 2563 bp, Homo sapiens
  Payload ID: 19562
  Gene Name: X-ray repair complementing defective repair in Chinese hamster cells 3
  Uniprot ID: O43542
  ENST ID: ENST00000352127
  CDS Start-End: 342-1382
actcagggtgctaggcgcctattggaggagaaggccgagaggagcaggacggcgggaagaggagtgcggaacccgcgggagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgca

SEQ ID NO: 200493 - DNA, 572 bp, Homo sapiens
  Payload ID: 19562
  Gene Name: X-ray repair complementing defective repair in Chinese hamster cells 3
  ENST ID: ENST00000554170
  CDS Start-End: 437-572
agatttgttctcgggttcacagtgctcagaggggaggagaggggaggaggtgaagacacctggcagggaagcagggcctccatggatggggtgcattcacggcagggagttctcagcaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgagg

SEQ ID NO: 200494 - DNA, 560 bp, Homo sapiens
  Payload ID: 19562
  Gene Name: X-ray repair complementing defective repair in Chinese hamster cells 3
  ENST ID: ENST00000553332
  CDS Start-End: 418-560
ctattggaggagaaggccgagaggagcaggacggcgggaagaggagtgcggaacccgcgggaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggca

SEQ ID NO: 200495 - DNA, 746 bp, Homo sapiens
  Payload ID: 19562
  Gene Name: X-ray repair complementing defective repair in Chinese hamster cells 3
  ENST ID: ENST00000553361
  CDS Start-End: 297-746
aggacggcgggaagaggagtgcggaacccgcgggagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctgagtggcagtattttttcatcggtggcacctccgagcacatctgc

SEQ ID NO: 200496 - DNA, 562 bp, Homo sapiens
  Payload ID: 19562
  Gene Name: X-ray repair complementing defective repair in Chinese hamster cells 3
  ENST ID: ENST00000555964
  CDS Start-End: 257-562
attggaggagaaggccgagaggagcaggacggcgggaagaggagtgcggaacccgcgggagagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatc

SEQ ID NO: 200497 - DNA, 801 bp, Homo sapiens
  Payload ID: 19562
  Gene Name: X-ray repair complementing defective repair in Chinese hamster cells 3
  ENST ID: ENST00000556980
  CDS Start-End: 464-801
gtatgattccacgaatcacacggtttattgtcaaagaagatttgttctcgggttcacagtgctcagaggggaggagaggggaggaggtgaagacacctggcagggaagcagggcctccatggatggggtgcattcacggcagggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaa

SEQ ID NO: 200498 - DNA, 575 bp, Homo sapiens
  Payload ID: 19562
  Gene Name: X-ray repair complementing defective repair in Chinese hamster cells 3
  ENST ID: ENST00000554974
  CDS Start-End: 91-516
aggacggcgggaagaggagtgcggaacccgcgggaggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcc

SEQ ID NO: 200499 - DNA, 2539 bp, Homo sapiens
  Payload ID: 19562
  Gene Name: X-ray repair complementing defective repair in Chinese hamster cells 3
  Uniprot ID: O43542
  ENST ID: ENST00000554913
  CDS Start-End: 310-1350
gagtgcggaacccgcgggagactttgagccaggcctgttaaaccaagttctcagcaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 200500 - DNA, 3018 bp, Homo sapiens
  Payload ID: 19562
  Gene Name: X-ray repair complementing defective repair in Chinese hamster cells 3
  Uniprot ID: O43542
  ENST ID: ENST00000553264
  CDS Start-End: 798-1838
ctccctgagcaggctgaacatgggcatacgagtgaccagcgtgatcgtgtccaggccagtgccgcattctgtgtggtccaagggaaaaccttctccaagtccacggcccgccctttcctctgctgggttacggccaagggcgccaggcctcactggaggacatggatcctggacccggccctcgaggctgctgccttccagtttccccatgtcctggacactcttggtctcaccatttgggaggccgacaggggatgcagagtggcctgttggaaaggccttatgtgaccccaggctgagtccctgagcagcctgctgaggccggaggggagaagagctgagcttctcccttgctgggccaggctcgggctgtggaatggctgccagctcccttcctgggagaggctgggtggggtccacagcaccttcctcccgtcccacaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 200501 - DNA, 535 bp, Homo sapiens
  Payload ID: 19562
  Gene Name: X-ray repair complementing defective repair in Chinese hamster cells 3
  ENST ID: ENST00000556682
  CDS Start-End: 351-535
attggaggagaaggccgagaggagcaggacggcgggaagaggagtgcggaacccgcgggaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcat

SEQ ID NO: 200502 - DNA, 2584 bp, Homo sapiens
  Payload ID: 19562
  Gene Name: X-ray repair complementing defective repair in Chinese hamster cells 3
  Uniprot ID: O43542
  ENST ID: ENST00000555055
  CDS Start-End: 364-1404
cgagaggagcaggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 200503 - DNA, 2599 bp, Homo sapiens
  Payload ID: 19562
  Gene Name: X-ray repair complementing defective repair in Chinese hamster cells 3
  ENST ID: ENST00000557439
  CDS Start-End: 378-830
ttggaggagaaggccgagaggagcaggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctgagtggcagtattttttcatcggtggcacctccgagcacatctgctaggctcacttcccacacagggccggaccccaggccctggacccacaggcccagccagccacctcctcacgggcctgacctgccagcagcggtgtggctgggaacctcacctctgccaccctcagcccaggggagggcaccctcttgtcaggtgcctgagtccctgcggctggtcttggggatgagcctggagacagccagaagccgggaggacaggagttggccttgaaaatgggagtctcccgcttaccgcacggaagagctgctgtgaggtggaggcgggactcgagcgtgctcaggaacgggacgggagccgccctcattctccagcgtcctccgtgccaggcttcgtgcaaatctgatttgtgcaatgactccccctcagcttccaccccgttggccttttcagtgaagcccacactccccgatacccagggacacagaagccttaggacaccctccctgaatcccccagctgtgcccagcccagtgactgctgcgggatgacagcacagtccagccttgcgggccaggggaagggagggggccccacggccaccgtgaccacatgcaaggttaggggtcagatgtgctttcctggggaaatgacttcctttcctggatccaatctaaaggcccgaattttgaaaagaaagcggcaggcgggctctgaagtgattccgactcccgtgcttaagccgcgtgaggctctcccaggcctgctggggccccgcccaccgctgggctgtccacagccaccctcctgccagcttcacgatgtccccatgactgtgcagcccctacataacgtcaccccaacaaaaacacgctgcttgaccggttccacctgcttccgagccttccagcccagcctctctccagccaacaggacggaggaagcccagggccccgaccttcctgtggctcctgactaggggcacagtcactgctggggacactggtggggaagggaaccagccacaaaagggatgtggcctcccaaggcagtatttatacgttcctggcctcaagcgggccagatgcttctcagaagcttagttctgacacagaatggggcggggggttcctgacccatttttgcaactcttctttacgtttgaaattctgtcaaagcaaaatcagctcagaattaaaggttacgcggacactcacaaacaggctgcatgacacggcgtgggggcactggctctcccacaactgcatgtgccactgcaggaacaggacgacgccccgtgggccacggggtcctggctgggcagccttcctggcatagtcagtgcttagagagctcgccggccttgtctttttgtttttgttttgcaggaaactggagttttattattactcaaatcagtccccctaagccttcctgttttttaaattgagatgtaatttacatgccataaaattccctctaaaagtgtacagttcggcctgataggcgcagtacctcatgcctgtaatcccagcactttgggaggccgaggctgaggcaggcggatcatgaagtcaggagttcgagagcagcctgaccaacatggtgaaacccagtctctactaaaaatacaaaaattagctgggcgtggtagcgcacgccttgtaatcccagctactcagaaggctgaggcaggagaatcacttgaacccgggaggcagaggttgcagtgagccgagatcgcaccactgcactccagcctgggcgacagagtgagtctcttgtctctcaaaaattaaaataaaataaataaatt

SEQ ID NO: 200504 - DNA, 1696 bp, Homo sapiens
  Payload ID: 19563
  Gene Name: X-ray repair complementing defective repair in Chinese hamster cells 4
  Uniprot ID: Q13426
  ENST ID: ENST00000282268
  CDS Start-End: 176-1180
cgggatttagatcacgtcccgcaggccggcggaagtagctgatactctcattggttgcaaaaccttgatctgtgaaagcgggcgttttggaagataccggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaagcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattg

SEQ ID NO: 200505 - DNA, 1579 bp, Homo sapiens
  Payload ID: 19563
  Gene Name: X-ray repair complementing defective repair in Chinese hamster cells 4
  Uniprot ID: Q13426
  ENST ID: ENST00000338635
  CDS Start-End: 100-1110
cggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagttt

SEQ ID NO: 200506 - DNA, 1530 bp, Homo sapiens
  Payload ID: 19563
  Gene Name: X-ray repair complementing defective repair in Chinese hamster cells 4
  Uniprot ID: Q13426
  ENST ID: ENST00000396027
  CDS Start-End: 57-1061
tgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaagcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagttt

SEQ ID NO: 200507 - DNA, 1636 bp, Homo sapiens
  Payload ID: 19563
  Gene Name: X-ray repair complementing defective repair in Chinese hamster cells 4
  Uniprot ID: Q13426
  ENST ID: ENST00000511817
  CDS Start-End: 81-1091
accggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaagattttgtgtttttaataaaatgtgtt

SEQ ID NO: 200508 - DNA, 3428 bp, Homo sapiens
  Payload ID: 19564
  Gene Name: X-ray repair complementing defective repair in Chinese hamster cells 5 (double-strand-break rejoining)
  Uniprot ID: P13010
  ENST ID: ENST00000392132
  CDS Start-End: 141-2339
acggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtg

SEQ ID NO: 200509 - DNA, 3761 bp, Homo sapiens
  Payload ID: 19564
  Gene Name: X-ray repair complementing defective repair in Chinese hamster cells 5 (double-strand-break rejoining)
  Uniprot ID: P13010
  ENST ID: ENST00000392133
  CDS Start-End: 462-2660
agaaaccccacaaaaattagctgggcttggtggcacacacctgtggtcccagctacctgggaggctgagctctggatcgtacaagaagggagacaaggaccactgacaagatatgcgtttcaggcggctcaaacaccacacgctcccgactacggcggaatggagagaatgtgcgcatgctcggcgggaatctgcgcatgctcggcgggaatctgcgcatgctcggagagaatctgcgcatgctcggccggaatctgcgcgagctcggcgggaatctgcgcaagctcggcgggaatctgcgcatgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaattgctgctaa

SEQ ID NO: 200510 - DNA, 415 bp, Homo sapiens
  Payload ID: 19564
  Gene Name: X-ray repair complementing defective repair in Chinese hamster cells 5 (double-strand-break rejoining)
  ENST ID: ENST00000451695
  CDS Start-End: 1-59
aagcaaagaaggtgataaccatgtttgtacagcgacagccatctgacatttttttctaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattctt

SEQ ID NO: 200511 - DNA, 605 bp, Homo sapiens
  Payload ID: 19564
  Gene Name: X-ray repair complementing defective repair in Chinese hamster cells 5 (double-strand-break rejoining)
  ENST ID: ENST00000417391
  CDS Start-End: 211-605
atctgccgcttgtccaccggaagcgagttgcgacacggcaggttcccgcccggaagaagcgaccaaagcgcctgaggaccggcaacatggtgcggtcggggaataagctgctgaaaactttgtagctctagtggaggagctgtttgttgcagatgaactggaagtaaaattctaacagcctgtattgcttcggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaag

SEQ ID NO: 200512 - DNA, 2709 bp, Homo sapiens
  Payload ID: 19565
  Gene Name: X-ray repair complementing defective repair in Chinese hamster cells 6
  Uniprot ID: P12956
  ENST ID: ENST00000359308
  CDS Start-End: 656-2485
gcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 200513 - DNA, 2296 bp, Homo sapiens
  Payload ID: 19565
  Gene Name: X-ray repair complementing defective repair in Chinese hamster cells 6
  Uniprot ID: P12956
  ENST ID: ENST00000360079
  CDS Start-End: 243-2072
gtaggaaggggcggggctttgccgaagggggcggggctctcgctgatgggttggctttcgtcagggacataggtagaagctggttggggagtgtgcgtgccagcctgacgcgatatagtgcgcacatgcgtgatgacgtagagggcgttgattgggaccgagtacagggcccgcgcatgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 200514 - DNA, 1958 bp, Homo sapiens
  Payload ID: 19565
  Gene Name: X-ray repair complementing defective repair in Chinese hamster cells 6
  ENST ID: ENST00000405506
  CDS Start-End: 60-1739
cgcctagtgagcagtagccaacatgtcagggtgggagtcatattacaaaaccgagggcgatgaagaagcagaggaagaacaagaagagaaccttgaagcaagtgtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttg

SEQ ID NO: 200515 - DNA, 2200 bp, Homo sapiens
  Payload ID: 19565
  Gene Name: X-ray repair complementing defective repair in Chinese hamster cells 6
  Uniprot ID: P12956
  ENST ID: ENST00000405878
  CDS Start-End: 147-1976
aagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 200516 - DNA, 2006 bp, Homo sapiens
  Payload ID: 19565
  Gene Name: X-ray repair complementing defective repair in Chinese hamster cells 6
  Uniprot ID: P12956
  ENST ID: ENST00000402580
  CDS Start-End: 67-1773
atgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatatactgtt

SEQ ID NO: 200517 - DNA, 2148 bp, Homo sapiens
  Payload ID: 19565
  Gene Name: X-ray repair complementing defective repair in Chinese hamster cells 6
  ENST ID: ENST00000428575
  CDS Start-End: 236-1915
gatgggttggctttcgtcagggacataggtagaagctggttggggagtgtgcgtgccagcctgacgcgatatagtgcgcacatgcgtgatgacgtagagggcgttgattgggaccgagtacagggcccgcgcatgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtgtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatatactgtt

SEQ ID NO: 200518 - DNA, 1245 bp, Homo sapiens
  Payload ID: 19566
  Gene Name: XRCC6 binding protein 1
  Uniprot ID: Q9Y6H3
  ENST ID: ENST00000300145
  CDS Start-End: 126-866
ggctgcccttcttccctgcggagggagggcctgggcggtcgcgttggcgggagggaggttacctttcccagtctcgctctggccgcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatggaaatgtcagtggaggttttgatgcttcaacatctcagatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatgagcacaatgacatttttatattacagagcttccatcatcatgaagaaaaaaaaatttggttctcaagtgaacaaacatataaaatgtaaacaatccctacaatccagataaaacagagaagactgtgattctagcatattatcagaaaaagtaactatggcaaaaaatgaaactgctttaaactccaaggcagaaattgtatctttatagctaaccatttagtaaataaatacattacatttttgtattttagtcatttgtttttattacatgtgattattttaaaatttgattatgaaacctgtgaagtgtgctcttccatgatgttgataggtgaccactgttggtatttacattaaatgtaaagaaatgtgtactga

SEQ ID NO: 200519 - DNA, 519 bp, Homo sapiens
  Payload ID: 19566
  Gene Name: XRCC6 binding protein 1
  ENST ID: ENST00000549257
  CDS Start-End: 1-113
tggcccaggggaatccccagcaagggttcttctccagcttcttcaccagcaaccagaagtgccagcttaggctcctgaagacgctggagacaaatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatga

SEQ ID NO: 200520 - DNA, 1245 bp, Homo sapiens; identical to SEQ ID NO: 200518
  Payload ID: 19566
  Gene Name: XRCC6 binding protein 1
  Uniprot ID: Q9Y6H3
  ENST ID: ENST00000571490
  CDS Start-End: 126-866

SEQ ID NO: 200521 - DNA, 519 bp, Homo sapiens; identical to SEQ ID NO: 200519
  Payload ID: 19566
  Gene Name: XRCC6 binding protein 1
  ENST ID: ENST00000570321
  CDS Start-End: 1-113

SEQ ID NO: 200522 - DNA, 644 bp, Homo sapiens
  Payload ID: 19567
  Gene Name: XXbac-B562F10.12
  ENST ID: ENST00000429594
  CDS Start-End: 1-196
cagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgaccccgcccccgcagggagctttcgcttgggaggaagaaggcgccgcaccgactatgcgggcgcttcagtcgcatcagcatgaagctgccccggatcccgctccggaggcagaaa

SEQ ID NO: 200523 - DNA, 4181 bp, Homo sapiens
  Payload ID: 19568
  Gene Name: XXbac-BCX105D18.9
  ENST ID: ENST00000468814
  CDS Start-End: 192-1097
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaccctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtg

SEQ ID NO: 200524 - DNA, 2878 bp, Homo sapiens
  Payload ID: 19568
  Gene Name: XXbac-BCX105D18.9
  ENST ID: ENST00000467760
  CDS Start-End: 569-1474
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 200525 - DNA, 1010 bp, Homo sapiens
  Payload ID: 19568
  Gene Name: XXbac-BCX105D18.9
  ENST ID: ENST00000460446
  CDS Start-End: 1-383
accacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgg

SEQ ID NO: 200526 - DNA, 3874 bp, Homo sapiens
  Payload ID: 19569
  Gene Name: XXbac-BPG116M5.17
  ENST ID: ENST00000456570
  CDS Start-End: 56-3856
atgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggaca

SEQ ID NO: 200527 - DNA, 3377 bp, Homo sapiens
  Payload ID: 19569
  Gene Name: XXbac-BPG116M5.17
  ENST ID: ENST00000477310
  CDS Start-End: 30-3377
tacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgggtctgcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataa

SEQ ID NO: 200528 - DNA, 612 bp, Homo sapiens; identical to SEQ ID NO: 150944
  Payload ID: 19570
  Gene Name: XXbac-BPG181M17.5
  ENST ID: ENST00000429234
  CDS Start-End: 87-612

SEQ ID NO: 200529 - DNA, 2705 bp, Homo sapiens
  Payload ID: 19571
  Gene Name: XXbac-BPG246D15.9
  ENST ID: ENST00000452392
  CDS Start-End: 175-2705
gaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaat

SEQ ID NO: 200530 - DNA, 1266 bp, Homo sapiens; identical to SEQ ID NO: 124851
  Payload ID: 19572
  Gene Name: XXbac-BPG32J3.19
  ENST ID: ENST00000503322
  CDS Start-End: 4-1152

SEQ ID NO: 200531 - DNA, 2332 bp, Homo sapiens
  Payload ID: 19573
  Gene Name: XXbac-BPG32J3.20
  ENST ID: ENST00000461287
  CDS Start-End: 261-452
aagttacagagacaacatgctgagagagcagaggagaccctccaggcaagggcagactccttgcaggggcaggctgggggcccccgctgcctgctgggtcaggctggtgaatctggtcatggttccgccccccagattcactccctaggtgtgtttgtttactggttcctcactgtcttgctcaaatgctccaactctacaaatcccgggatctcggggtgcagatcacctctcccagattcctgagcctgtgtctggccatgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcagatgcccattgctgatgccccgtgtcagcccaggtcactggcaaggcaggcattttgatgacactgtggatctcaggcaaggggatcaaaggagcatcaggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttct

SEQ ID NO: 200532 - DNA, 2487 bp, Homo sapiens
  Payload ID: 19574
  Gene Name: XXbac-BPG32J3.22
  ENST ID: ENST00000375880
  CDS Start-End: 119-805
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 200533 - DNA, 1903 bp, Homo sapiens
  Payload ID: 19574
  Gene Name: XXbac-BPG32J3.22
  ENST ID: ENST00000409691
  CDS Start-End: 1-639
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 200534 - DNA, 991 bp, Homo sapiens
  Payload ID: 19574
  Gene Name: XXbac-BPG32J3.22
  ENST ID: ENST00000617558
  CDS Start-End: 13-927
gctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattgttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaaca

SEQ ID NO: 200535 - DNA, 408 bp, Homo sapiens
  Payload ID: 19575
  Gene Name: XXcos-LUCA11.5
  ENST ID: ENST00000606589
  CDS Start-End: 119-271
gtgacggagcggcggtgcgcgcggcagggcccggagtatcccgctttctttggaggaaaccaccgcatcagatctgcgctgcggcagaggcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccacaccaggaatcctccatcatcaatgaggacacagagctgggtgatgcctacgtgttgagatcctggtccctccacacacgctctaccagctgctgcgtgatgcccgtgtccaagatcaggttgtgcagaaggaagttgttgcctggaacaggaggggaggggt

SEQ ID NO: 200536 - DNA, 2727 bp, Homo sapiens
  Payload ID: 19576
  Gene Name: xyloside xylosyltransferase 1
  Uniprot ID: Q8NBI6
  ENST ID: ENST00000310380
  CDS Start-End: 110-1291
cccctttcatggccgccgcctggcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatgg

SEQ ID NO: 200537 - DNA, 564 bp, Homo sapiens
  Payload ID: 19576
  Gene Name: xyloside xylosyltransferase 1
  Uniprot ID: Q8NBI6
  ENST ID: ENST00000356740
  CDS Start-End: 1-564
atgaatgggatgagtgtcctgatgaaagagaccctgaagagctctgtcaccccttcaccatatgaggagactggggaaaggcagccatctgtgaactgggcagtgagtcctcaccagacacagaatcagtgggcacgttggtcttggacttcccagcctctagaactgcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactag

SEQ ID NO: 200538 - DNA, 582 bp, Homo sapiens
  Payload ID: 19576
  Gene Name: xyloside xylosyltransferase 1
  ENST ID: ENST00000418940
  CDS Start-End: 20-274
ctctctgtcctgctgcactatggtgagatgtgtcccttccgccgtgattgtgtgtttcctgaggcctccccagccaggcagaactgtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagtgtacacctcttgtacaaggtagaacatcttgcacataacagaaggcctgtctgtcggtcccactttccaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctg

SEQ ID NO: 200539 - DNA, 865 bp, Homo sapiens
  Payload ID: 19576
  Gene Name: xyloside xylosyltransferase 1
  ENST ID: ENST00000429994
  CDS Start-End: 84-827
gtgagagtcagtgagctctcaggagatctgctgtttgaaagtgtgtagcgcttcccccttctctctctctgtcctgctgcactatggtgagatgtgtcccttccgccgtgattgtgtgtttcctgaggcctccccagccaggcagaactgtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctg

SEQ ID NO: 200540 - DNA, 557 bp, Homo sapiens
  Payload ID: 19576
  Gene Name: xyloside xylosyltransferase 1
  ENST ID: ENST00000455281
  CDS Start-End: 1-343
ctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaagtttttgacttctgaggatgggactggtcaccagtagtcatcctgagcaactggagagggccttggtgaggcctctggaagtgttgaagttgcagtgacacttctcattgctcttaaggtcatcttccacgatgttgctgtgctgacggataagctcttccccatcgtggaggccatgcagaagcacttcagtgctggcttgggaacctactacagtgactccatcttcttcctctcggtcgccatgcatc

SEQ ID NO: 200541 - DNA, 2149 bp, Homo sapiens
  Payload ID: 19576
  Gene Name: xyloside xylosyltransferase 1
  Uniprot ID: Q8NBI6
  ENST ID: ENST00000437101
  CDS Start-End: 463-1035
aattgaagtagtcacttctttcagaatgctaagttccctggaatattttcccagcctactgtgtctatgatagactcaaatattggaagttttaccggctgtgtgtggggtggggaaggaattctgttggttctccggtgagtcctgaagagaccttgtttctggagccaggaagaggagcatagaaagaaaaaggaacaggaaattgttcaaaagaagttcatgaaatgagaaaagcagcaggaaacagctcgggaatcggcgaggctgcagccgaaggaagacatcttccttttaagcagtgactcgggaatcgaggccacttccatcctgtaacgacgccatctggagcatgtggcttccaggggagcagtggctgaggccctgcagtggcttctcactgctacagtccagagttgcacacagcacttctgctcatagtccatcagccaggagctagtcatgtggccacctcgctgcaaggatccaggaaggcagagtgcggagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctc

SEQ ID NO: 200542 - DNA, 1747 bp, Homo sapiens
  Payload ID: 19577
  Gene Name: xylosylprotein beta 1,4-galactosyltransferase, polypeptide 7
  Uniprot ID: Q9UBV7
  ENST ID: ENST00000029410
  CDS Start-End: 112-1095
cggggcggacaggcctgggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaa

SEQ ID NO: 200543 - DNA, 544 bp, Homo sapiens
  Payload ID: 19577
  Gene Name: xylosylprotein beta 1,4-galactosyltransferase, polypeptide 7
  ENST ID: ENST00000505468
  CDS Start-End: 437-544
aagcggcgcagctgccctgggaggacggcaggtgcttggggtagacgagttatgtgcagcctcctcgtggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctg

SEQ ID NO: 200544 - DNA, 552 bp, Homo sapiens
  Payload ID: 19577
  Gene Name: xylosylprotein beta 1,4-galactosyltransferase, polypeptide 7
  ENST ID: ENST00000510761
  CDS Start-End: 426-552
gcacgatgttcccctcgcggaggaaagcggcgcagctgccctgggaggacggcagttttgaggtcctgtaaccagagcagctgaggattcaaacctcgtagtacgaaggtctgtatgagacaagaaaggaaaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacgg

SEQ ID NO: 200545 - DNA, 410 bp, Homo sapiens
  Payload ID: 19577
  Gene Name: xylosylprotein beta 1,4-galactosyltransferase, polypeptide 7
  ENST ID: ENST00000507061
  CDS Start-End: 1-234
aggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtaactcccactggaagatggattctcagccccaccagcctgatcttcccaccttttcaagtccccttgatccagatccccagaccccccccttttccctgccacccttcttgtctttacttcctccttacccaacctggagtccaaggtccatcattaaaaccctccctggcatactcc

SEQ ID NO: 200546 - DNA, 1064 bp, Homo sapiens
  Payload ID: 19577
  Gene Name: xylosylprotein beta 1,4-galactosyltransferase, polypeptide 7
  ENST ID: ENST00000505433
  CDS Start-End: 50-562
ccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcagccttgcccaccctgcacaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggaca

SEQ ID NO: 200547 - DNA, 9891 bp, Homo sapiens
  Payload ID: 19578
  Gene Name: xylosyltransferase I
  Uniprot ID: Q86Y38
  ENST ID: ENST00000261381
  CDS Start-End: 86-2965
gcggccgcgggagctgcggggagcgcgggggcggcccggagcgtgccggggtccccgcgcctcgctcgccggccgcgctccgaagatggtggcggcgccgtgcgcccggaggctggcccggcgctcgcactcggcgctgctcgcggcgctcacggtgctgctgctgcagacgctggtcgtgtggaatttcagcagcctcgactccggggccggggagcgccgcgggggcgcagcggtcggcggcggggagcagccgcccccggccccggccccgcgccgggagcgccgggacctgcccgccgagccggctgcagcccgaggaggaggaggaggcggcggcggaggaggaggaggacgggggccccaggcgcgggcgcggggaggcggccccggagaaccgcggggacagcagccggccagccggggggcactgcccgcccgggctctggatccacacccaagtccgctcatcaccctggagactcaggatggctacttttctcatcggccgaaagagaaagtgcgaacagacagcaacaacgagaactctgtccccaaagactttgagaatgtcgacaacagcaacttcgcacccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcatgccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggttcattcggaagcagggcctggatcggctcttcctggagtgcgacgctcacatgtggcgcctgggagatcggcggatcccagagggcattgccgtggatggcggttcggactggttcctgctgaaccggaggtttgtagaatatgtgaccttctccacagacgatctggtgaccaagatgaaacagttctactcctacaccctgcttcctgctgagtccttcttccatacggtcctggagaacagcccccactgcgacaccatggtggacaacaacctgcgcatcaccaactggaatcgcaagctgggctgcaagtgccagtacaagcacatcgtggactggtgcggctgctcccccaatgacttcaagccgcaggacttccaccgcttccagcagacagcccggcctaccttctttgcccgcaagtttgaagccgtggtgaatcaggaaatcattgggcagctggactattacctgtacgggaactaccctgcaggtaccccgggcctgcgctcctactgggagaatgtctacgatgagcctgacggcatccacagcctgagcgacgtgacactcaccttgtaccactcctttgcccgcctgggtcttcgacgggccgagacgtccctgcacacggatggggagaacagctgccgatactacccaatgggccacccagcatctgtgcacctctacttccttgctgaccgcttccagggctttctgatcaagcatcatgctaccaatctggctgtgagcaaactagagactctggagacctgggtgatgccgaaaaaagtcttcaagatcgcaagcccacccagtgactttgggaggcttcagttttccgaggtcggcactgactgggatgccaaggagaggctattccgcaactttgggggtcttctggggcccatggatgagccggtgggtatgcagaagtgggggaagggacctaatgtgaccgtgaccgtcatttgggtggatcccgtcaatgtcatcgcagccacctacgacatcctcattgagtccactgccgaattcacacactacaagccccctttgaacttgcccctgaggcctggggtctggacagtgaaaattctccaccactgggtgccagttgcagagaccaaattcctcgttgcgcctctgaccttctcgaacaggcagcccatcaaacctgaggaggcactgaagctgcacaatgggcccctccgcaatgcctacatggagcagagcttccagagcctaaaccccgtcctcagcctgcccatcaaccccgcccaggtggaacaggcacggaggaacgcagcctccacgggcacagcgctggagggatggctggactcgttggtgggcgggatgtggactgccatggacatctgtgccacgggccccacagcctgcccggtcatgcagacctgcagccagacggcctggagctccttcagccctgaccccaagtcggagctgggggcagtcaaacctgatggccggctcaggtagcactgggcacgaggagtgggccacagcaggatctcaacgggaaagcagccagaggggttgtggggcctgaaccccggcctcccaccctgggggaggccctctgtgaatgggtctctcctggccatagaatgatggaaagggaaggtcagcaggtcaaagcaggatcagccaacaacctgcctttggcaagctgcgggtgggatggctcagtccctgcactgtgactgtctcacctcttctggttgatcctcaagtcctacaggttccttgtcttccccttccagtgacccacccctgaccccagacgtgtgattttcagacttttctttcgagcagcagaacttcgtttacggagcacagtcataagtggaggttcagggtgctgacgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatttaaacaacaaaaaacagtatgatttaagtgttgagttaccagaaacccaaaaggtttccttgccacgagccccctggagtgtcatccctgttcaccaggagagctcttcgcaggaggcctcccttgctcctgtaatcccacctcccctgaatgatgggattcccttggaaaaaggtctcacccctggtagccatctgcccttcccatggagagccagtcctgacacttctctccagcgtgggtttgaaggggctgcccttcgctttgtgtgacttgtcctaatcctagccagatgtgttgccccatcccaagcctcgcaaggcagggtgtcctgttggcaatggaggacgtagagaagggacactttagatatttattatttacatgttttagtcgatgactaattagtaggtgctgtttttgcagcttgtcaattatgttaccttactaactgaagctgcctttattcacaaaaggccccttttcccatcttttcccaccccctggtgtctctctctctctcggtttctctttctctgcgtctaccccccatcctcctcatcctcagagtaaagcaggggcatcgaacaccacgcaaagaaagctccaacccgcatcttccactggctttgagtggggtgccttggggaccgttggagccttgtttttttccttatgcagagtgtcagcctcactctccctcggattccaagagtattggaattcctgagcctcccatcctccccctactcaccccccgtcacaggcacaaggaggtgacaggcagaaaacgtggagggtgagtggggaatgtgctagctgcagagagtttgtggggaatgtgctagctgcagagagtttgggccattcctgcttgctccgtggttgccttcccatggcccatctaattatgggcattcatgcgaccttaacagagggaaacaggctcctttgagagagatccatcttaggaggagggtcgtcagatccaggcagcagagtccgggagatagccattctcaacagcgattccagggatctcagggtacttttctcagaaagcccctatgatctcttttacagactctatggtggccacgcgctgggtgccacatcctctttctgcccccggcctctgcctctggccagggtttccctggggctgccgaagccactttgggagcttccctttcaccctccttgctgggccaccagtgctttgtgttcgcagcgttatttgcagtggctttggggactcagcagtggcaagtccctgtgcataatgtgaacctgcagacttcaagatggggcccctcctgcacccactaacatgtctgcctttttttgtttttatcctggaacaagtggagaaatggcagagctggctgactctggggacccttccctttttcccatggcttcatttcttcctcaccacaactaattcggggagctgagaagtcacacagggtattcctctcccttctctgatgttattaattaatagaccagagaataaggttgcagatattacatttgttgtgtttttgtgttttgtttttttttttaaggaaaatcccaaacaaagcccagcatgatttgagaaaagaggatgttttcccagggaaaataatttttttaacctgcctgagaatgatttatttatttgttggaggccattggtcagacagcctggagcttgggctgtggaagatttcaaaagcatagggctgtggtctctggaaacctattacagcctgcagctgtgagctgagccagtgacgaggtccctggaaactcaggaaggctgacaggtgggccttggggtattggtttgtggagaaggaagcattctttaggctgcggcactccttatagtttcccacccaccgagtgacattcaggcagaaattgagctcaggagacagccagccttcccacatcccacttcacttcccggtccacacgtaaagcagtgtgtctccaaggaggcagtgagcaattcccaaggtccccgtgttgtgagaagcgcgctgctttctccctttgcaggggaaaaaaaaggctttcctggtgagatcatgagtccttccggcttcatttctcattgtgggtttaacttctaaaacgcaaatggagtttagagaggatgagcagaaccacaggacctgcccccatctctcactcactgcaattgcttctactctgggcacaagtagggtgtctgaagaccatgtttccctctggttctctagtttgcagataacacagaagacactggctagaaccttaagctttctgccaaaaagatgcagagagcagggcagtagctactggcagtggggtgtgaataaagagtcctttcacaaccaagttcactgaggatttggagcaccagcttcccagcagtatcgaggggtggagaggtgtacattcaggtggaggggtacatctaggggtggagaggtgtacattctagaaacagctgttaacacactccactttaaagacagcaagctagacctgcaggatcaaagccacacactgtggtaggggttacaaatgtttatggggcccagaatactagcatagatgcgtgaaatggttggtgtgaggcaaaagggcatggtgggggcaaggatggggactgtggtcttactggcatgcacgtgacctacccagaatgagcagctgctactcagccccaacctgtcattgtttgtaaaaatgtaagcacagtgtagtggaatcttccaatttggaagggaagccggaaatccagatttaatggaaaaaatctgatttttcaacgtcgggttgtttgtttgtttgtttttgttttttttaacagatagtgggcaaagaaaaattccactgttccacgtgtacactgccagcaacctctgctctctggagaggtggtttaaagtgagattatgcattgccctggtagaagaggaaaaaagccagcatcaggtcagggcaaaaataacagcccatgttgaactcggaatggggacctcttgctaagtcattccactcctcaagagaccattccacagaggggggatggatcattcagctctcctggtcccaagattgtgctgaagggaagaaggaatagaatctggagatctggactgctgccccttagatatgcagaggtccacatctgcctggggctacagcttgtgggactccatcaaaccaggccgaaatggcaaagacagtctaggaggaggaggaggtagggtgtgaaacagccaggctctctccaaatcccaagtgttgacacagccatcttgtcccatccctggaagcctctttggaaaccacatagagctgtgctggctcacgggatgtcctgtttgcttctgcctcagttaccttactttgcccatgggtctaccacaggcgctacctcattgtgtctgctgagaagtttacctgggaggggggaacaaagttgtccaaatctgcttgagctgaatgtatgatctatgcaaattctctctctcctctctctcttcctctctggctctcttagaagtttttttgttttgttttgttttgttttgtgtttaccttgcaaacaagatactgtataggaccctcttaagatggaggagggctttcttgcgccacctgtgtctacccctcacgttgtctttggctctggtcttaccaggcgtatgcagggagaaagtgacctctcttccctctccacttggctgggaatattccaactgcctctgcctacagataccaccagaaagcgggttctgcaccttgtcatccccctccctaacgtcatctactccatccctcatgttcctccaacttgcttctcccatccctccttcaaaaacaaaacaaaacaaaacaaaagccttaggtttctcctttttgaaatgtggccttaacattatttttgggaagctgaccatccatcctttccctcccatctccaccaacatcagagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgccttttttttttttaaatattatgttgtcaatagcatttgtttgggtatttgttttagaggcctcactctaagttattaccgtccccttcattgttttcaaagacatgtggtgatatagtttttaaaaataactattttgttatagatcataatatgcataaaactgtacagaaatattttgtaatgtgttgattttaaaaaaaatctgtaaataaagttttaaaaaaagaattcaaatggcacacgctgaaatatgtagatattttgctatttatttaaaggagtattttaagagatattgaactatctgaaattgaccagtaatcaaagttccaatcatctgaatgcttttccttgaggtagaatgtgagtctcagaaatgactgcattacctgcccttttttgcaccttttctgtctttttattttgcagaacaacaacaacaacaaaattgtgccttagctgtatttttttgtctaggggagtttgtttctgtctgacaaagcaacattttttgcagaaaacagtggatgtattaaatactgtatcataccaaaaacactgcaggtgtatatagatgctttctgtcatactgtgttttcagatgcagaattttaaaattaaaaaaacactgcctttatggaacagtgactatatgtggcttcttttcagcaacattgtgcatctttacacaatctcatattctcttctgtcatctgcatggtgaagataggatgactatataatttatcatccaaactgggatacttttgagagttaaaggaagcaccacgtggatgggatgctgagactgcaggcataaatggcctatcctgggaaaacctgggtgtgtggacacatttccctcataaaaactgctgtcatcttctaactggattatagcaacaacctcctataagtacctcctggttgaggcagaagtatatgatttttaaacccgtactgagtagagaataacaagaagggactgccatggaaagttgcagtttcctatacccaactggttggttggttggcaaacgtgttttcctttcctctttaccacagagactacatttcccagactgccttgctcttagctgtgaccatgtgaccaggccaatggaacagctagactgcatcttccagactgccttgctcttagccatggccatgtgactgactcaggccaatggaatg

SEQ ID NO: 200548 - DNA, 3507 bp, Homo sapiens
  Payload ID: 19579
  Gene Name: xylosyltransferase II
  Uniprot ID: Q9H1B5
  ENST ID: ENST00000017003
  CDS Start-End: 50-2647
gcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgagggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacccccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgaggatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttttttttttttttttttaatttaaaaaggaaaatgggtggttgggagagaaactagaacagaagatgtgcaatagggctcagagcagccccaggaagtgggccatgtctgtggggagcaggggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 200549 - DNA, 3267 bp, Homo sapiens
  Payload ID: 19579
  Gene Name: xylosyltransferase II
  ENST ID: ENST00000376550
  CDS Start-End: 6-1925
ggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgagggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacccccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgaggatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttttttttttttttttttaatttaaaaaggaaaatgggtggttgggagagaaactagaacagaagatgtgcaatagggctcagagcagccccaggaagtgggccatgtctgtggggagcaggggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 200550 - DNA, 145 bp, Homo sapiens
  Payload ID: 19579
  Gene Name: xylosyltransferase II
  ENST ID: ENST00000509778
  CDS Start-End: 11-145
gggcaggaagatggtggcgagcgcgcgagtgcagaagctggtgcggcgctacaagctggcgattgccacggcgctggccatcctgctgctgcagggcctgaaaggaaggcagaggaagccacggccactggaccctggcgagggt

SEQ ID NO: 200551 - DNA, 2107 bp, Homo sapiens
  Payload ID: 19579
  Gene Name: xylosyltransferase II
  ENST ID: ENST00000507602
  CDS Start-End: 7-2037
aggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgagggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacccccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgaggatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggagaacaggggtctctccatgttgcccaggctggtctcaaactcctggcctcaagcagtcctcccgctccaacctcccaaagcgttgggatgacaggcatcagccactactcctggcctcaaagtaccattaaaaaaaaaaaaaaatcttaggtaacacatgc

SEQ ID NO: 200552 - DNA, 587 bp, Homo sapiens
  Payload ID: 19579
  Gene Name: xylosyltransferase II
  ENST ID: ENST00000511654
  CDS Start-End: 1-354
tgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctc

SEQ ID NO: 200553 - DNA, 901 bp, Homo sapiens
  Payload ID: 19579
  Gene Name: xylosyltransferase II
  ENST ID: ENST00000574840
  CDS Start-End: 1-141
gagacgcttgagatgtggctgatgccccaagggtcgctgaagctgttggggcgcagtgaccaggccagccggctccagagtctggaggtgggacaggtcccccacttgctttctcccaacccccacccagacttggggtagtgggaagagagggacagacaccaagggaggggtaaggttatttttcccagtcatggcagccatggtgatgcccccatgcagacatcctgtgtcaccccccagcctgtgcacactgaggagcacctcctggttggggtatgcagaggacatgcagggagcagggagggaattatcagttccactacaacacaagcccaatcttccagactacagagatttcgcctagaggggcagggacattcgagttgggccatgaaactacacttctgagtggctcctcatagtctttttttttttttttttgagacagtctcactctgtcgcagtggcacaatctcggctcactgcaacctctgcctcccaggttcaagcgattctcctacctcagcctcccgcgtagctgggactacaggcgcgcgccaccacgcccagctaatttttttttttgtatttttaatagagacggggtttcaccatgttgaccaggatgatctcgatctcctgaccttgtgatccacccgcctcggcctcccagagtgctgggaatacaagcgcaagccaccgcgcctggcccctcctcatagtctctttctcagaggctttggcttcatgtgggaatggtctctgggcaggactttgaacctcatccctgccgtattgtccccaataagggggactgacctccactgcctagcagtcagaatggaagcctagaacgaatctcagagctgggagagatattaaaggtctcctagtctga

SEQ ID NO: 200554 - DNA, 3664 bp, Homo sapiens
  Payload ID: 19580
  Gene Name: xylulokinase homolog (H. influenzae)
  Uniprot ID: O75191
  ENST ID: ENST00000207870
  CDS Start-End: 91-1701
ccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggactcagggtggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagctgcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacggagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttgg

SEQ ID NO: 200555 - DNA, 3484 bp, Homo sapiens
  Payload ID: 19580
  Gene Name: xylulokinase homolog (H. influenzae)
  ENST ID: ENST00000424034
  CDS Start-End: 62-247
gactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttggcaacacggaagtatatactggaaggctggagcccagcaggcactgacaagcttatcaccagacctccggctacaccagcagctgcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacggagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttgg

SEQ ID NO: 200556 - DNA, 1666 bp, Homo sapiens
  Payload ID: 19580
  Gene Name: xylulokinase homolog (H. influenzae)
  ENST ID: ENST00000427323
  CDS Start-End: 110-310
ggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttggagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtagtcccagctactcgggaggctgaggcaggagaatggcgtgaacctgggaggcagagtttgtagtgagccgagataatgccactgcactccagcctgggtgacagagcaagactctgtctcaaaaaaaaaaaaaaaagaaagagaaaatactgtttctattgaaatgtaattcacataccataaaattcaccttttaaaatgtacaatttgatggttttagtatattcaaagaacaatatcactatcaccactatgtaatcttagaacattttcaccacctggaaaggaaaccctgtattaattagcatccactgtatagtccccctcctgccagtagtggcaaccacaatcaactctctatctctggatttgctgattctggacatttcgtagacatgaatatatataatatgtgacagccttcttttacttagcataatgctttctttttaaaaaattttcatagctttttgtttatttcaaataccaacttgaaccagatacctggcataatgttttcaaagttcatccatgtcatagcgtgtgtcagtacttcattcctttttgtggttcagtaatattccattgcattgatatatcagagtttgtttttccattcaacttttagacatttgagttgttctgcttttttgctattgtgagttattctgctatgaacatccacatatgttatggattgaattgtggccccccagaattcatatgttggaagcctaccctcatcatgacagtatatttggaggtgaggcctttaggtagataattaaggttaaatgaggttgtaagggtggggctctaatttgataggacctgtttccttataagaaggagagacaccagtgctatcccacttcatgcgcagatgcacagaggaaaggccttgtgagaaggcggctgtctgcaagctggaaagagagccctaaccagaaactgaatttgctggcaccttaattgtggacttctagcctccagaactgtgagaaaataaatgcctgttgtttaaacca

SEQ ID NO: 200557 - DNA, 1514 bp, Homo sapiens
  Payload ID: 19581
  Gene Name: Y box binding protein 1
  Uniprot ID: P67809
  ENST ID: ENST00000321358
  CDS Start-End: 140-1114
agttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataat

SEQ ID NO: 200558 - DNA, 1524 bp, Homo sapiens
  Payload ID: 19581
  Gene Name: Y box binding protein 1
  ENST ID: ENST00000436427
  CDS Start-End: 1-1124
cgcgtgtgcgacggggtcccctccccgccgaccggcctcgtgcgctcgggcccgcacgccgttgttcgcgtcacccccacccagctcccttccgcgtgtgctcggagggcgcggcgcaccgcctacgcaggccggagcggcttccccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataat

SEQ ID NO: 200559 - DNA, 776 bp, Homo sapiens
  Payload ID: 19581
  Gene Name: Y box binding protein 1
  ENST ID: ENST00000332220
  CDS Start-End: 127-776
gcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcag

SEQ ID NO: 200560 - DNA, 1369 bp, Homo sapiens
  Payload ID: 19581
  Gene Name: Y box binding protein 1
  ENST ID: ENST00000616651
  CDS Start-End: 140-1102
agttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcgcggcgcagggagcggtggcccgggcggcccacatcggcggcgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaagccaggcccaacaacgccggccctacccaggcgaaggttcccaccttactacatgcggagacctatgggcgtcgaccacagtattccaaccctcctgtgcagggagaagtgatggagggtgctgacaaccagggtgcaggagaacaaggtagaccagtgaggcagatatgtatcggggatatagaccacgattccgcaggggccctccgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttt

SEQ ID NO: 200561 - DNA, 1590 bp, Homo sapiens
  Payload ID: 19582
  Gene Name: Y box binding protein 2
  Uniprot ID: Q9Y2T7
  ENST ID: ENST00000007699
  CDS Start-End: 65-1159
ggttcgcgagccggggggaggggccggggcggtggcggctgtggccggtactggacccggcgggatgagcgaggtggaggcggcagcgggggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggctttcctgtggt

SEQ ID NO: 200562 - DNA, 640 bp, Homo sapiens
  Payload ID: 19582
  Gene Name: Y box binding protein 2
  ENST ID: ENST00000571464
  CDS Start-End: 1-493
ggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctgggttgaaggaagggagccatccttactgttcagagacagcaactccctcccgtaactcaggctgagaaggaaccagccagctcttacctcctcctggttgcttttctt

SEQ ID NO: 200563 - DNA, 1796 bp, Homo sapiens
  Payload ID: 19583
  Gene Name: Y box binding protein 3
  Uniprot ID: P16989
  ENST ID: ENST00000228251
  CDS Start-End: 202-1320
gcgaggagcccaagagagagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaa

SEQ ID NO: 200564 - DNA, 1708 bp, Homo sapiens
  Payload ID: 19583
  Gene Name: Y box binding protein 3
  Uniprot ID: P16989
  ENST ID: ENST00000279550
  CDS Start-End: 197-1108
gagcccaagagagagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagga

SEQ ID NO: 200565 - DNA, 685 bp, Homo sapiens
  Payload ID: 19583
  Gene Name: Y box binding protein 3
  ENST ID: ENST00000544622
  CDS Start-End: 1-277
aaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatatctctgatgtatggtttaatagaagatagctggattctcacatctgtttctgcattcagtctgctgagagaccacatgtcattgtagcctttgggagaccccaccatatacttctgagagaatgcctgggaaaggcaaatagcatcttagtaatattatggcaatagtttgacctcgctgaccccctggaagttttcagaaatcccatccacactttacagacttgtaggaagaataccacttgggtcaaatatgttggtaacatcataaaatgtattcttttttggcttttccctgacattgcctcagtggatggtaaatgctgggagacacgcatttgatggagcaaaaattataaaccttgcagatactcttcgggtggttggttagctgatacgagttctaatgagatgactattaaattgattgtagattga

SEQ ID NO: 200566 - DNA, 899 bp, Homo sapiens
  Payload ID: 19584
  Gene Name: Yae1 domain containing 1
  Uniprot ID: Q9NRH1
  ENST ID: ENST00000223273
  CDS Start-End: 44-724
gttggcgcttccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttt

SEQ ID NO: 200567 - DNA, 968 bp, Homo sapiens
  Payload ID: 19584
  Gene Name: Yae1 domain containing 1
  Uniprot ID: Q9NRH1
  ENST ID: ENST00000432096
  CDS Start-End: 14-634
aattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgaggaactcaacggattggagcctactgggcttgagagccccgctgaggagtccggaggttgggacgcaactactgccgcgtcccctcccggtccccggccacatggcgagcggggcgacaccgaagcagcccacggagctcgaggcgacgctgctgagcctggttccccaaagcggccgcgccactccccgcttccccgcccggctccgggccccaggccctgggacgccgagccaccgccggcgtttcagacgcaaaccccaccgcgaccctgcagcagcctgccccgcctggccgccagaggcaccttccaactccgaaacacatttttcaacatataatagaatcattatcagaggtggacacatttagaagttgttcttaatcagagggcagcttgtgcttaggaaagccagcctcagtcctcagcacccagcacccagtgctgcaggtttctcctgggtgaagatggaccagcccaccttggccctccggcaagctagaacaatatgtacacgtctctcaaactatgaagagaagatttgggaggagtatgagaaaatcctcaataccaaactagcagagcaatacgagtcgtttgtgaaattcacacatgagcagattatgcgaccatgtgggacaagcccaacaaactatgtgtcttgaagctttttgttgcagatctcggtaccaggtttgacctcaa

SEQ ID NO: 200568 - DNA, 425 bp, Homo sapiens
  Payload ID: 19584
  Gene Name: Yae1 domain containing 1
  ENST ID: ENST00000448268
  CDS Start-End: 26-289
ctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaaga

SEQ ID NO: 200569 - DNA, 1019 bp, Homo sapiens
  Payload ID: 19585
  Gene Name: ybeY metallopeptidase (putative)
  Uniprot ID: P58557
  ENST ID: ENST00000329319
  CDS Start-End: 399-902
gctctcgcgtcctttgctgggtccagacaccggtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 200570 - DNA, 890 bp, Homo sapiens
  Payload ID: 19585
  Gene Name: ybeY metallopeptidase (putative)
  Uniprot ID: P58557
  ENST ID: ENST00000339195
  CDS Start-End: 399-773
gctctcgcgtcctttgctgggtccagacaccggtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgaggtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 200571 - DNA, 764 bp, Homo sapiens
  Payload ID: 19585
  Gene Name: ybeY metallopeptidase (putative)
  Uniprot ID: P58557
  ENST ID: ENST00000397691
  CDS Start-End: 144-647
ggaaccgctccttccgctccgcccgcctggagtccttctggccggattccgcggcatccttccatagaccctcgttgttgcttcctccttgtggtaaatgttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 200572 - DNA, 433 bp, Homo sapiens
  Payload ID: 19585
  Gene Name: ybeY metallopeptidase (putative)
  Uniprot ID: P58557
  ENST ID: ENST00000397692
  CDS Start-End: 77-316
gctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 200573 - DNA, 534 bp, Homo sapiens
  Payload ID: 19585
  Gene Name: ybeY metallopeptidase (putative)
  Uniprot ID: P58557
  ENST ID: ENST00000397694
  CDS Start-End: 77-445
gctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgta

SEQ ID NO: 200574 - DNA, 744 bp, Homo sapiens
  Payload ID: 19585
  Gene Name: ybeY metallopeptidase (putative)
  Uniprot ID: P58557
  ENST ID: ENST00000397701
  CDS Start-End: 124-627
cccacaacccgctctgtggcggggcttccggtcgggagggtccgcccgctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 200575 - DNA, 1351 bp, Homo sapiens
  Payload ID: 19586
  Gene Name: YdjC homolog (bacterial)
  Uniprot ID: A8MPS7
  ENST ID: ENST00000292778
  CDS Start-End: 51-1022
ggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaa

SEQ ID NO: 200576 - DNA, 1066 bp, Homo sapiens
  Payload ID: 19586
  Gene Name: YdjC homolog (bacterial)
  Uniprot ID: A8MPS7
  ENST ID: ENST00000398873
  CDS Start-End: 22-471
gagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccat

SEQ ID NO: 200577 - DNA, 1410 bp, Homo sapiens
  Payload ID: 19586
  Gene Name: YdjC homolog (bacterial)
  Uniprot ID: A8MPS7
  ENST ID: ENST00000415762
  CDS Start-End: 51-461
ggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaa

SEQ ID NO: 200578 - DNA, 6506 bp, Homo sapiens
  Payload ID: 19587
  Gene Name: YEATS domain containing 2
  Uniprot ID: Q9ULM3
  ENST ID: ENST00000305135
  CDS Start-End: 196-4464
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgtgg

SEQ ID NO: 200579 - DNA, 1024 bp, Homo sapiens
  Payload ID: 19587
  Gene Name: YEATS domain containing 2
  ENST ID: ENST00000432781
  CDS Start-End: 1-658
tggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccgattgataccagccagcatacggctggcactggtctaccggaaaaactgaatatcaccgagatacacacacacactcacgcatgcagacaacaccccttactgcctttggataagaggctgtggatgttgttgttgtcattactattattacttcattcatatgtagctccacaccaggccccttgtgtcttgtttggatagagaacaaaaaattaaggctgattatatttttctcttgatttctacctccctgttaaaattgaccaacttctagtatagggagtacttgttctctactaactgttttatttgaggccctgtgttggatactggagtagaaattgtagaaataaaaggaattattataataa

SEQ ID NO: 200580 - DNA, 1434 bp, Homo sapiens
  Payload ID: 19588
  Gene Name: YEATS domain containing 4
  Uniprot ID: O95619
  ENST ID: ENST00000247843
  CDS Start-End: 271-954
cgcgagcccgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 200581 - DNA, 827 bp, Homo sapiens
  Payload ID: 19588
  Gene Name: YEATS domain containing 4
  ENST ID: ENST00000552955
  CDS Start-End: 195-827
atggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggcaaaatggctcattcctgtaatctcagcactatgggaggcccaagcgggaggatcgcttgagcccaggagtttgagaccagactggcaacatagtaagactccatctctacagaaaaaaaaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaaca

SEQ ID NO: 200582 - DNA, 1100 bp, Homo sapiens
  Payload ID: 19588
  Gene Name: YEATS domain containing 4
  ENST ID: ENST00000548020
  CDS Start-End: 264-785
ccgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaattt

SEQ ID NO: 200583 - DNA, 884 bp, Homo sapiens
  Payload ID: 19588
  Gene Name: YEATS domain containing 4
  ENST ID: ENST00000549685
  CDS Start-End: 545-884
tgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggctggagtgcactagcgcaatctcggctctccgcaacctccacctcctggattcaagcgattctcctgcctccaagcgattctcctgcctcagcctcctgaatagctggaattacagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaat

SEQ ID NO: 200584 - DNA, 4441 bp, Homo sapiens
  Payload ID: 19589
  Gene Name: YES proto-oncogene 1, Src family tyrosine kinase
  Uniprot ID: P07947
  ENST ID: ENST00000314574
  CDS Start-End: 134-1765
ttgctgccgccgggcgccccgggacgaggaggtggaggagggagagggcccgcgggcctcgcctccgccctccgccacctcgagctgcggtagcagcgactcatgagagcgcggccggaggacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcac

SEQ ID NO: 200585 - DNA, 4639 bp, Homo sapiens
  Payload ID: 19589
  Gene Name: YES proto-oncogene 1, Src family tyrosine kinase
  Uniprot ID: P07947
  ENST ID: ENST00000584307
  CDS Start-End: 172-1803
ggtcgggagaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactca

SEQ ID NO: 200586 - DNA, 4554 bp, Homo sapiens
  Payload ID: 19589
  Gene Name: YES proto-oncogene 1, Src family tyrosine kinase
  ENST ID: ENST00000577961
  CDS Start-End: 72-1718
gctgtggaagagagccaccattatcaaaatgatcacagttgcaaacattcgtgcttcaaataccagccactatgttagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactca

SEQ ID NO: 200587 - DNA, 5386 bp, Homo sapiens
  Payload ID: 19590
  Gene Name: Yes-associated protein 1
  Uniprot ID: P46937
  ENST ID: ENST00000282441
  CDS Start-End: 389-1903
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 200588 - DNA, 5284 bp, Homo sapiens
  Payload ID: 19590
  Gene Name: Yes-associated protein 1
  Uniprot ID: P46937
  ENST ID: ENST00000345877
  CDS Start-End: 389-1801
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 200589 - DNA, 1490 bp, Homo sapiens
  Payload ID: 19590
  Gene Name: Yes-associated protein 1
  Uniprot ID: P46937
  ENST ID: ENST00000531439
  CDS Start-End: 1-1467
atggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattct

SEQ ID NO: 200590 - DNA, 1415 bp, Homo sapiens
  Payload ID: 19590
  Gene Name: Yes-associated protein 1
  ENST ID: ENST00000529029
  CDS Start-End: 1-776
ataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaata

SEQ ID NO: 200591 - DNA, 2393 bp, Homo sapiens
  Payload ID: 19590
  Gene Name: Yes-associated protein 1
  Uniprot ID: P46937
  ENST ID: ENST00000526343
  CDS Start-End: 389-1741
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgc

SEQ ID NO: 200592 - DNA, 1638 bp, Homo sapiens
  Payload ID: 19590
  Gene Name: Yes-associated protein 1
  Uniprot ID: P46937
  ENST ID: ENST00000524575
  CDS Start-End: 446-1426
ctgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatc

SEQ ID NO: 200593 - DNA, 5350 bp, Homo sapiens
  Payload ID: 19590
  Gene Name: Yes-associated protein 1
  Uniprot ID: P46937
  ENST ID: ENST00000537274
  CDS Start-End: 389-1867
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 200594 - DNA, 5398 bp, Homo sapiens
  Payload ID: 19590
  Gene Name: Yes-associated protein 1
  Uniprot ID: P46937
  ENST ID: ENST00000615667
  CDS Start-End: 389-1915
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 200595 - DNA, 1365 bp, Homo sapiens
  Payload ID: 19590
  Gene Name: Yes-associated protein 1
  Uniprot ID: P46937
  ENST ID: ENST00000629586
  CDS Start-End: 1-1365
atggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 200596 - DNA, 1851 bp, Homo sapiens
  Payload ID: 19591
  Gene Name: Yip1 domain family, member 1
  Uniprot ID: Q9Y548
  ENST ID: ENST00000072644
  CDS Start-End: 372-1292
ccccggatctccggcttccggcaactgggctggaccgaaaccggcgcggagcaactgaggcccgagccttctcgggacccgggggacgcctaaccccgcgagatgaggaaactgaggccgcgaggagcgcgcatacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccagggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgc

SEQ ID NO: 200597 - DNA, 1503 bp, Homo sapiens
  Payload ID: 19591
  Gene Name: Yip1 domain family, member 1
  Uniprot ID: Q9Y548
  ENST ID: ENST00000371399
  CDS Start-End: 586-957
cgaaaccggcgcggagcaactgaggcccgagccttctcgggacccgggggacgcctaaccccgcgagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccagggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatga

SEQ ID NO: 200598 - DNA, 1042 bp, Homo sapiens
  Payload ID: 19591
  Gene Name: Yip1 domain family, member 1
  ENST ID: ENST00000412288
  CDS Start-End: 392-1042
ggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcatacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcagta

SEQ ID NO: 200599 - DNA, 1602 bp, Homo sapiens
  Payload ID: 19591
  Gene Name: Yip1 domain family, member 1
  Uniprot ID: Q9Y548
  ENST ID: ENST00000464950
  CDS Start-End: 71-991
ggggacgcctaaccccgcgagaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccagggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgca

SEQ ID NO: 200600 - DNA, 2087 bp, Homo sapiens
  Payload ID: 19592
  Gene Name: Yip1 domain family, member 2
  Uniprot ID: Q9BWQ6
  ENST ID: ENST00000253031
  CDS Start-End: 128-1078
ggatgttgctgtcaggtctgagtcggttggagtctgacgggtaggcgagacgcgcaggcgcagagagccccagccacgccggcccaggtggcctcagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtca

SEQ ID NO: 200601 - DNA, 656 bp, Homo sapiens
  Payload ID: 19592
  Gene Name: Yip1 domain family, member 2
  ENST ID: ENST00000585858
  CDS Start-End: 97-656
gtctgacgggtaggcgagacgcgcaggcgcagagagccccagccacgccggcccaggtggcctcagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccat

SEQ ID NO: 200602 - DNA, 430 bp, Homo sapiens
  Payload ID: 19592
  Gene Name: Yip1 domain family, member 2
  ENST ID: ENST00000591872
  CDS Start-End: 1-240
ctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggtaaggactattcccagctgggctaagggggctgccctcccactcccagtcaaggcgagaggttctggggccactcccagacaattctttctttcaggcaacacctaagtggaccaacccctctgcctgtcctgccccccagacgatgactgaaggctcctttgacacctt

SEQ ID NO: 200603 - DNA, 796 bp, Homo sapiens
  Payload ID: 19592
  Gene Name: Yip1 domain family, member 2
  ENST ID: ENST00000587943
  CDS Start-End: 543-796
ggcgcagagagccccagccacgccggcccaggtggcctcagcgagggatgcggagacgcccctgaacgaccatggcatcggccgacgagctgaccttccatgcccccagctgacccaggctctccgggcaggcactgaatgcccgcaatgtgcagctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaa

SEQ ID NO: 200604 - DNA, 1550 bp, Homo sapiens
  Payload ID: 19592
  Gene Name: Yip1 domain family, member 2
  Uniprot ID: Q9BWQ6
  ENST ID: ENST00000586748
  CDS Start-End: 174-1124
ggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaa

SEQ ID NO: 200605 - DNA, 932 bp, Homo sapiens
  Payload ID: 19592
  Gene Name: Yip1 domain family, member 2
  ENST ID: ENST00000586575
  CDS Start-End: 622-932
ggttggagtctgacgggtaggcgagacgcgcaggcgcagagagccccagccacgccggcccaggtggcctcagaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcac

SEQ ID NO: 200606 - DNA, 958 bp, Homo sapiens
  Payload ID: 19592
  Gene Name: Yip1 domain family, member 2
  ENST ID: ENST00000590329
  CDS Start-End: 106-939
ggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatgtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacag

SEQ ID NO: 200607 - DNA, 879 bp, Homo sapiens
  Payload ID: 19592
  Gene Name: Yip1 domain family, member 2
  ENST ID: ENST00000589971
  CDS Start-End: 1-620
ctggcaacctgacgctggtgctggcccagaggagggacccctccatccactacagcccccagttccacaaggcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctc

SEQ ID NO: 200608 - DNA, 950 bp, Homo sapiens
  Payload ID: 19592
  Gene Name: Yip1 domain family, member 2
  ENST ID: ENST00000592646
  CDS Start-End: 1-509
ggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacagacaattctttctttcaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgc

SEQ ID NO: 200609 - DNA, 753 bp, Homo sapiens
  Payload ID: 19592
  Gene Name: Yip1 domain family, member 2
  ENST ID: ENST00000588347
  CDS Start-End: 103-753
aggtagggctgggggccgagggaccggctcgggggcgggggggaagtgtgcctgaccggtctctgtcctcagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtg

SEQ ID NO: 200610 - DNA, 1576 bp, Homo sapiens
  Payload ID: 19593
  Gene Name: Yip1 domain family, member 3
  Uniprot ID: Q9GZM5
  ENST ID: ENST00000372422
  CDS Start-End: 184-1236
cccccgtccacgtccccagcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaactgca

SEQ ID NO: 200611 - DNA, 1005 bp, Homo sapiens
  Payload ID: 19593
  Gene Name: Yip1 domain family, member 3
  ENST ID: ENST00000416380
  CDS Start-End: 136-327
cgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgca

SEQ ID NO: 200612 - DNA, 843 bp, Homo sapiens
  Payload ID: 19593
  Gene Name: Yip1 domain family, member 3
  ENST ID: ENST00000455768
  CDS Start-End: 113-250
ggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatg

SEQ ID NO: 200613 - DNA, 1674 bp, Homo sapiens
  Payload ID: 19593
  Gene Name: Yip1 domain family, member 3
  ENST ID: ENST00000460547
  CDS Start-End: 127-318
cctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcaggctcctggagtccatgatccctatcaagatggtcaacttcccccaggtgaatagagggtggcatgtctggagagccgggggaagcaccagggcagagggtgggaccaccaggcaaatcctgggaagccataaacagatgagctgttgtaccctccagcctgaatgaattggtatattgacagaaaattgcaggtgaactctatggacctctcatgctggtcttcactctggttgctatcctactccatgggatgaagacgtctgacactattatcgtaagcaggacagacaactttgggggggtggctgcactaggttgaaagctgcctgaggatacaatggtggagtgagacaggaacagcccctgcggaaggccctaggtgaggctgagatcagaggcctcctaggactaaatagagccttcaccccacagcgggagggcaccctgatgggcacagccattggcacctgcttcggctactggctgggagtctcatccttcatttacttccttgcctacctgtgcaacgcccagatcaccatgctgcagatgttggcactgctggtaaggagccaggtgtggtgggcaagagtgatgttaaaaagagtagccaggccttggtcggcatctgtcctggggccccaaagcctggaatgggaggagtaggccaatggaccatgtgtttcccagggtccccatgaggggccagaaagcagcccaacctgaatgattttcctctccaccatcctccttcccagggctatggcctctttgggcattgcattgtcctgttcatcacctataatatccacctccacgccctcttctacctcttctggctgttggtgggtggactgtccacactgcgcatggtaagctgggcaagaggcttccaggggtgggctgtcctcccagggagttggggaagacagcctggagctgtccatctcacaaagagccctaaatgggagggaagagcccaaagatggttctgccctgggtgggggtgtcttgtccccactcctcactttggagccaggccctttgagctgtattctcatggtcctaggtagcagtgttggtgtctcggaccgtgggccccacacagcggctgctcctctgtggcaccctggctgccctacacatgctcttcctgctctatctgca

SEQ ID NO: 200614 - DNA, 566 bp, Homo sapiens
  Payload ID: 19593
  Gene Name: Yip1 domain family, member 3
  ENST ID: ENST00000511831
  CDS Start-End: 239-566
tctttgggtcttcgtgcacactaaagtcagtgggattaacattgacctgaaagggccagactactactccagcctgaggatctcgggtttcagggcccgcccgaggcattaggaagaagcagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaact

SEQ ID NO: 200615 - DNA, 933 bp, Homo sapiens
  Payload ID: 19593
  Gene Name: Yip1 domain family, member 3
  ENST ID: ENST00000503972
  CDS Start-End: 147-933
gtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatcatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctacc

SEQ ID NO: 200616 - DNA, 406 bp, Homo sapiens
  Payload ID: 19593
  Gene Name: Yip1 domain family, member 3
  ENST ID: ENST00000500090
  CDS Start-End: 1-406
ggaaaagacaagcctccagggccttcagcttgtacgccaacatcgacatcctcagaccctactttgatgtggagcctgctcaggtgcgaagcagaactctgtgcttgccagccgggcatggtggctcacgcctggaatcccagcactttgggaggccgaggcgggcggatcacaaggtcaggagatcgagaccatcctggctaacacggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagt

SEQ ID NO: 200617 - DNA, 1321 bp, Homo sapiens
  Payload ID: 19593
  Gene Name: Yip1 domain family, member 3
  ENST ID: ENST00000490447
  CDS Start-End: 166-360
gcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagcagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacct

SEQ ID NO: 200618 - DNA, 1444 bp, Homo sapiens
  Payload ID: 19593
  Gene Name: Yip1 domain family, member 3
  ENST ID: ENST00000506469
  CDS Start-End: 135-1205
gggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgaga

SEQ ID NO: 200619 - DNA, 1639 bp, Homo sapiens
  Payload ID: 19593
  Gene Name: Yip1 domain family, member 3
  ENST ID: ENST00000510102
  CDS Start-End: 179-370
gtccacgtccccagcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaa

SEQ ID NO: 200620 - DNA, 11949 bp, Homo sapiens
  Payload ID: 19594
  Gene Name: Yip1 domain family, member 4
  Uniprot ID: Q9BSR8
  ENST ID: ENST00000238831
  CDS Start-End: 247-981
gttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaagctggagtgcaatggcacgatctcggctcactgcaagctctgcctcccgggtttgcaccattcttctgcctcagcctcacgagtagctgggactacaggcgcccaccaccatgcctggctaattttttgtatttttagtagagatggggtttcaccgtgttaaccaggatggtctcgatctcctgacctcgtgatccgcccgcctcagcctcccaaagtgccgggattacaggtgtcagccaccgcaccaggccagttcattagaatttttaaaacaggctgggcatggtggcttacgcctgtaatcccagcagtttgggaggccgaggcaggtggatcacctgaggttgggagtttgagaccagcctgaccaatgtggagaaaccccatctctactaagaatacaaaattagccaggcatggtggtgcatacctgtaatctcagctactggggaagctgagacaggagaattgcttgaacccaggaggcagaggttgcggtgagctgagatcgcgccattgcactccagcctgggcaacaggagtgaaactccatctcaagaaaaacacaaaatacaaaacaaaacaaaacaaaaaaacagaactgggccgggcgcggtggctcacgcctgtaatcccagcactttgggaggccgaggcgggtggatcacgagatcaggagatcaagaccatggtgaaaccccgtctctactaaaaatacaataaattagccgggcatggtggcgggcgcctgtagtcccagctacttgggaggctgaggcaggagaatcgcttgaacccgggaggcagaggttgcagtgagccaagatcgtgccactgcactccagcctaggtgacagagtgagactccgtctcaaaaaaaaaaaaaaaaaaaatcaaaatctatataattaagcattgttttttaaaaagtagtttaggaagatttgtaaagcttatgaaccattgtaaaaccttatttctaaggtctgtaagacagttttatatgtaataatgtgtccatttccaggaattccccaaatactcatacagccattgagcaccccaatccaaaattcagaatgcttcagataagaacatttttgagtgccgatgtgacactttaaaggaaatgttcattggagcattttgcatttcagatttttggattaggaaaactcaaccactgtatttctgcacatattccaaaatctgaaaaagtctgaaacctgagaaactctggtcccaagcattttggaaagggtatactcaatctgtattaacatagacttctaaattagtgaaaatttgcattgaattaaaatgtgaagtaaatatttttgtttaaatattgtttaaaatttagtcatttaaaaattttgtgatgtaacaaaatgttgaatgaaataatgcttctacaacttaaaattatttttcatagtgaacaaaactagttgaatacttctaaatattcatttttgttagtgcacattttatccagttttaggctttagggaattgtgaccctttttttttttttttttttttttttggagacggagtcttgctctctcgcccaggctggagtgtgtggcgcaatctcagctcactgcaacctctgattcctgggttcaagcaattctcatgtctcagcctccctaatagctaggattaccggtgcccgccaccacgcccagctaattttttaaatttttaatggagacagggtttcaccatgttggccaggctggtcttaaactcctgacctcaggtgatccacccaccttggcctcccaaagtgctgggattacaggcttaagccaccgtgcccggcacttttgtttttaaaataatatcttactttcatatgattctttcagactgtggtatggcattctgaagcaagtcttaacagagctaaaaatcacccttacccaattctctgcactgacatatgtacacaaagtaatattttattattctccttcataaatggtttctttaattgaacctttgagccttatactatttttaaatttccctttaaaaattgaattacagccaggcatggtggctcatgcctgtaatcccagaactttgggaggccatggcaggaggattgcttgaacccaggagttgtagaccagcctgggcaagatagcgagatcctgcctctgaaaaaatcataataatactttaatttagaaaataccctgaattagaagtgcttcattcctcatttgtgtacagctgttcctctatatacgaaggggattggtaccagaaccactgcataccaaattccacccatactcaagtctcacagtcttccctgcagaatccaagtatacaaaaagtaggcctatcatttatatgggttttgcatcctgacagtactgtattttcaatcctagtttgtttgggaaaaaaaaattgtttgtatgcctgggtacagtatcatacctgtaatcccagcactttggaaggctgaggcgggaggactgttttgtggccaggagttcaaaatcagcctggtcgacgtagtgagaccccatctctacaaaagaaaaattagctgggcatgtggcacctgcctgtggtcccagctactcaggaggctgtgaggcaggagaattgcttgagcctgggaggttgaggctgcagtgagccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcagcattttgtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggtgaaaattttagaccaaaccatgtctttctgggttgtagtgattaaaaaatggttaagagaatgttccctatacaaggcatatgttattaaacatgaaatttaggattagttttctctttgaaaattcttttgatatgctgaggttacagtttggaggttacattagagaaagaatatagggaagatggcagtggtaaaacatttccctgctttacatttttatattggcagtatcttggtttcaacttttctattttcagcaagatatttgcaagtttttactttgaagatgtttggtttatagtagtccatgctatactaatgctgttgctgagataattaagttagatactaatatgaaaaagaatatttgtgtaaaatattttgaagttgtaattagtgtatatacaagttgttaatacttacgaaaaaaggaagcattcccacctgtaataattttgttaacactagactatcagtaaattatcaagaataaaaaccttggtttttctgtaatatttgccactgagcaatttttattaaaaaccaaacagaagtatttacacaagaacaagtgaaattacacaaaatgataatggggagaaatttctcatctggtgataaagggaaaaagataatgtaaaagcagattgctgctatttgcataataagcacttgttgaagaataaatgattaagttcaatatttttgctctattttatacctactcactttggtggaattagttctccatgtaaagtatctttttaatagtaagcaccatttaataatgaaacaactcatatgttttgtaatccttatggagaattacttcatgtgataattatagtctcttcatggaaaacagtaaaaatactcacgtttatgatgatgggcctaggtactaaattcctcattcaatctttttttaccaaatggtacttaataaaatcttttaccttataaaaatctattttcggccaggcgcggtggctcacgcctgtaatcccagcactttgggaggccgaggtgggcggaccacgaggtcaggagatcgagaccatcctggctaacacggtgaaaccctgactctactaaaaataccaaaaattagccgggcgtggcagcgggcgcctgtagtctcagctactcgggaggctgaggcaggagaatggcgtgtacccgggaggcggaggttgcagtgagccgagatcgcgccactgcactccagcctgggcgacagagcgagaatccgtctcaaaaaaaaaaaaaaaaaaaaaaaaaaaaaaaattattttcaaaggattgtgctagtggtggcctgaataataaaacattgagaagaaacagcctttgaatttggcaccctgaatgtgaagggacaatagatattaatcacatatttattaaccccttcctgtatgaacctagtactgtgctgagtgtagggatacagtgataatgcaaaaaagacccccaataggccgggcgcggtggctcacgcctgcaatcccagcactttgggagaccgaggcgggtggatcacgaggtcaggggatcgagaccatcctggctaacacggtgaaaccccgtctctactaaaaatacaaaatttagccgggcgtggtagcaggcgcctgtagtcccagctgcttgggaggctgcggcaggagaatggtgtgaacccgggaggcggagcttgcagtaagcagagatcgcgccactgcactcccgcctgggtgacagagcgagactctgtctcaaaaaaaaagaccgccccccccaatatacacacaccctgactttaatgagcttattttgctggggactcagccaattaatttcacaaattgtaaaactatttcaagaaatgagaaaaagaggcctgtggtggtaagcaagtatataaaagaagccttccttgaagcaacgatgcttaagctgaaatcttagggaaaaataaaagttaactaggcaaagaaggtagggaagactctttcagatagaatcgcagtttgtgagtttgcttggggaaaaaaatttaaaaatataaaaagaaaaccagtttgaagtttagtggttaatgaaattgaacaggtatgtcagcaccatacctgacattctaggccattctttctttgtcagagcttttttgttgagatggagtctcgctgtctcgctgaggctggagtgcagtggtgcaatctcggctcactgcaacctctgcctcccaggttcaagtgattctcctgcctcagcctcccaagtagctgggattacaggtgcccatcaccacacccggctaatttttttgtttttagtaaagacggtttctccatgtaggccaagcgggtcttgaactcccaacctccggtgatctgcccacctcaacctcccaaagtgctgggattacaggcgtgagacactgtgcccagcctgtcagagcttttgagtagaaatacggtatcagaaatgtgctttattttattttattagacaaagtcttgctctgttgccaggctggagtgcagtggcgcgatcttggctcactgcaacctctgccttctgggttcaagcgattctcctgcctcagcctcccgagtagctgggattacaggcacccactgccacactcggctaatttttgtatttttagtagagacgggatttcaccatgttggtctcgaactgctaacctcaggtgatctgcccgccttggcctcccaaagtgctgggattataggcatgaaccactgcgcccagccagaaacgtgcttttaatactaaaggccaagatatgcaattatactcttgacatatattcaaccgaaatgcatgtacatgtaccataagagacatatgtacaagaatgtgcacagttaacattattcaaatagccaaaaacgggaacatgtccatcaacacagaatagacaagttggtataattacacaatggaatcttatgcagcaatgaaaataaatgaactaaagccgcatacaaaaacatgaagaatttcacaagtattatgttgagtgaaaaagacaaagaatttgtactgtattacttcatttatatgaagttcaaacacaggcaaaattaagctatagtgtttagggatgcatactgaaatgcagtcttttaaaacagctttagaattccttggccaggtgcggtggcttacgcctgtaatcccagctctttgggaggcagaggctggcagatcacctgaggttgggagtttgagaccagcctgaccaacatggagaaaccccatctctactaaaaatacaaaattagctgggcgtggtgtcgcgtgcctgtaatcccagctactctggaggctgagacaggagaatcgcttgaacctgggaggtggagagtgtggtgagctgagatgtcaccattgcactccagcctgggcaagaagagcaaaacttcgtctcaaaaaaaaataaaaaaataaggctccaagcgctgttgtgagggttaaatgaactagataattaatgtaataaacagaatagttttggcattcaacaaacattggctgttattatattagctattaaaaatttaagtcatttaggtcaatgaaacaggagggtttccagaattatacccaattaattatacatgggaaggtgatgaaggtagcatgtcaaattggtataaaaagatggaatattaaataagtggggatactgtatcagataggaacatatttggttgcaagaaacaaaaattcctgtgattactagcttcactgtgagtttattttttcacgtaataaatccaaggttacataatccataactgatatggcagtttaacagtgttattaagaactcaaggtccatttattgctctattctgccatctttggtgagtggctttcatcctcattgtctcagaaaagttatttcacctctaagtattacatctacatttcaagcaggaagaagatgaagcttaagagaccaaatggagcatgtcagtcaaaggtgtccttatttaaaatctctggaagccccacttagtggcttccatccatgtctcatgggacagaactgaatcacatagccatcccttgctgtaagagagttggggaaagtattttaagctgggacatcccagccctgagtgaagtcagggatctgttaggaagaatggatgctaggtaggtaaatggcaatgtctgacaaagacatggtaggccagtctgaaaaatgtaaagctgggctgcgcgcggtggctcacgcctgaaatcccagcactttgggaggccgaggcgggcggatcctgaggtcaggagatcgagaccatcctggttaacgtggtgaaaccccgtctctactaaacatataaaaaattagccgggcttggtggcgggcgcctgtagtcccagctactgaggcaggagagtggcatgaacccgggaggcggagattgcagtgagccgagatcgcgccactgcactccagcctgggtgacaaggcaagactccgtctcaaaaaaaaaaagaaaaatataaagctggatctatacctcactccttataccaaagtacattacccttgtatcaaatattttaaaaactggaataagcttttcatataatctttgagaagatggggctttcaaagcgttaaatgaaacacagaagccatggccaggcacggtggctcatgcctgtaatcccagctctcagggaggcaagaggcaggagcatagcttgagcccaggcgttcaagacctgcctgggcaatatagcgagaccccgttctccccaaaaaggaaaaaaaaaaaaaaaccaaaaaaaaaaaaaaagtataaagcacagaagcgaaaggaaaagtgatgaagacacttgaagacctgtcatttaaaatgattctacaggaaaaagatgaactacaaattggggaaaaatatttgtaggacttatgtagacaaaggactaattttcttaataaaaacatttatcagtaaatttaaatgggcaaaggaaatacttggacaatcatatcatgtatgtaatattaatatttataaatcaataaaatgggctagggatataaatcagcaattcaaggggagggtaaaaagaccaactaatatatgtaaagatgcacaaattcattcatgattaaatgtgaattaacaacgttggcctctcggattcccaaaactttaaaagattaataatatccagtattggttgggattataagcagatatgatatttcactgatagagaccagcatgactgtctcaattgttaaactattgaaatgcatctgtgtcaatggtaaatagtattattgtaagtacaacactaaaattaataaattgtgtaaattctaa

SEQ ID NO: 200621 - DNA, 728 bp, Homo sapiens
  Payload ID: 19594
  Gene Name: Yip1 domain family, member 4
  ENST ID: ENST00000437765
  CDS Start-End: 1-177
gaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttgtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaa

SEQ ID NO: 200622 - DNA, 312 bp, Homo sapiens
  Payload ID: 19594
  Gene Name: Yip1 domain family, member 4
  ENST ID: ENST00000441084
  CDS Start-End: 1-101
cccctgtacttttggtggttggatcatttgaagtggtgtctacacttataaaagtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatc

SEQ ID NO: 200623 - DNA, 3147 bp, Homo sapiens
  Payload ID: 19595
  Gene Name: Yip1 domain family, member 5
  Uniprot ID: Q969M3
  ENST ID: ENST00000274496
  CDS Start-End: 136-909
ggaagccgttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaattttaactgtgttattgaatttacttttactaaactactgttctctttgtctcttttttaactaggctctgattttgacccctaatttaagctttaagaatagaaatcagctaatatagaatcagacaaaaaggggattaaatgagcagtttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttaaagagattttcagactaaatagaaatgtcaaaatgatgtatcaatggttcttttttagaacaagttttcaaagcataaaaagaggttgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaattttttattgtaattcttggatagtatttttgtctttttcaattcatttgtctttttcagtatagtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagtttaaattattgtagagattttttttgtggtggttattttttattttgctccaaaataataaggtgcaaagctattttatgcttaactgttgctctgtcaaaacagctatgcagtggagttgcatttgatgttctagagtttgattacatgcagagttgtatatagccaaaacttctcttatcaaactctgttatgtaggcatatttatatatacattaaagactgttgtactgtgtctcaaaaagta

SEQ ID NO: 200624 - DNA, 2255 bp, Homo sapiens
  Payload ID: 19595
  Gene Name: Yip1 domain family, member 5
  Uniprot ID: Q969M3
  ENST ID: ENST00000448443
  CDS Start-End: 358-1131
agcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaagattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaa

SEQ ID NO: 200625 - DNA, 2135 bp, Homo sapiens
  Payload ID: 19595
  Gene Name: Yip1 domain family, member 5
  Uniprot ID: Q969M3
  ENST ID: ENST00000513112
  CDS Start-End: 400-1011
agcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaagacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaa

SEQ ID NO: 200626 - DNA, 653 bp, Homo sapiens
  Payload ID: 19595
  Gene Name: Yip1 domain family, member 5
  ENST ID: ENST00000522203
  CDS Start-End: 349-653
ctcccgcccaccggtgcccaacctgctaacacgcctgcgcgagcgggcgtgccccggaagccgttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaatatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcag

SEQ ID NO: 200627 - DNA, 684 bp, Homo sapiens
  Payload ID: 19595
  Gene Name: Yip1 domain family, member 5
  ENST ID: ENST00000519064
  CDS Start-End: 154-684
cacgtagcaacggggctggttcagggtctgaaacagagtttgggggttgtttgggattagtgaagctactgcctttgccgccagcgcagcctcagagtttgacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcatta

SEQ ID NO: 200628 - DNA, 6134 bp, Homo sapiens
  Payload ID: 19596
  Gene Name: Yip1 domain family, member 6
  Uniprot ID: Q96EC8
  ENST ID: ENST00000374622
  CDS Start-End: 286-867
gccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaact

SEQ ID NO: 200629 - DNA, 1070 bp, Homo sapiens
  Payload ID: 19596
  Gene Name: Yip1 domain family, member 6
  ENST ID: ENST00000451537
  CDS Start-End: 506-1070
ggcgcagagtcagaggggcaggggcggcggcggagggagcaggaggttggggcttgagcccgtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctca

SEQ ID NO: 200630 - DNA, 6741 bp, Homo sapiens
  Payload ID: 19596
  Gene Name: Yip1 domain family, member 6
  Uniprot ID: Q96EC8
  ENST ID: ENST00000462683
  CDS Start-End: 745-1455
ttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggggcggcggcggagggagcaggaggttggggcttgagcccgtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaagaa

SEQ ID NO: 200631 - DNA, 937 bp, Homo sapiens
  Payload ID: 19597
  Gene Name: Yip1 domain family, member 7
  Uniprot ID: Q8N8F6
  ENST ID: ENST00000332990
  CDS Start-End: 18-860
atgtcatcttttcaccaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggcaggaaaagttcagtttggttatgtgtatggcatgagtgccattggctgccttgtgattcatgccttgctgaacctgatgagctcttcaggggtgtcgtacggctgtgtggccagcgtgctgggttactgcctgctccccatggtcatcctgtctggttgcgccatgttcttttcactgcagggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttgg

SEQ ID NO: 200632 - DNA, 1196 bp, Homo sapiens
  Payload ID: 19597
  Gene Name: Yip1 domain family, member 7
  ENST ID: ENST00000415895
  CDS Start-End: 77-847
accaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggcaggaaaagttcagtttggttatgtgtatggcatgagtgccattggctgccttgtgattcatgccttgctgaacctgatgagctcttcaggggtgtcgtacggctgtgtggccagcgtgctgggttactgcctgctccccatggtcatcctgtctggttgcgccatgttcttttcactgcagggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttggtgatatgatttctgttttattgcttttgagagagtaataagcagagagacaaagcagcacttaagggtggtgctctaatagcctgttggtttgaatgatgttttgcttttgagtttggtgcattaaaacatttcaaaatacttaaaatcaaaagggatacagttgctgtactgatcaaccctgcttttctcaatagaggtatttctgagaaaagtaagtaaataaactcatatgtttactaaaaggaaatctctagtaagccttttgagaaa

SEQ ID NO: 200633 - DNA, 484 bp, Homo sapiens
  Payload ID: 19597
  Gene Name: Yip1 domain family, member 7
  ENST ID: ENST00000508947
  CDS Start-End: 368-484
cgaaggtaccccccgtaggatccggtggacaggactcaaacagatcctgtgaagcgaagacaatgaaccccggggagctctgcccaagtaccagatccggaagcaacccgaagcggcggcgcagcttgccgacgtctgcacgccgcacgctgtcgtgacatcagcgcgtcttggcgccgggtagtggagtggtcactttgggaaagtcaggcaggaatgacttgtttctgtgatgtctgtggcctcaactgggatgactcgaccagctggggacttgaaaatcgggcatctctttctctctcatcttgtagtcacagtctctccatgtggtctccccatacagcctcttcagcatcacaatctcaggatgtcaaacttggcacaatttgactctgatttttaccaatctaattttactattgataaccaggagcagagtggtaatgactctaatgcctatggaaatctttatggatctagaaag

SEQ ID NO: 200634 - DNA, 943 bp, Homo sapiens
  Payload ID: 19598
  Gene Name: Yip1 interacting factor homolog A (S. cerevisiae)
  ENST ID: ENST00000359461
  CDS Start-End: 161-886
atgacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaagaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 200635 - DNA, 1124 bp, Homo sapiens
  Payload ID: 19598
  Gene Name: Yip1 interacting factor homolog A (S. cerevisiae)
  Uniprot ID: O95070
  ENST ID: ENST00000376901
  CDS Start-End: 186-1067
gaagagccaatggcaggcgcgggggatgacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 200636 - DNA, 619 bp, Homo sapiens
  Payload ID: 19598
  Gene Name: Yip1 interacting factor homolog A (S. cerevisiae)
  ENST ID: ENST00000431556
  CDS Start-End: 23-619
ggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggatgcctggctctgagccacccctgctttggcgcaggttctccccggaggtgctgggcctgtgtgcaagcacagcgctggtgtgggtggtgatggaggtgctggccctgctc

SEQ ID NO: 200637 - DNA, 541 bp, Homo sapiens
  Payload ID: 19598
  Gene Name: Yip1 interacting factor homolog A (S. cerevisiae)
  ENST ID: ENST00000484814
  CDS Start-End: 144-305
gtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacgctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccagctgcccacacatacagctgactcttctctgtcctgttggctgcacagggccaggcccatcgtggacacccaggcgatggccttcattacttacgtgctcctggctgggatggcactgggcattcagaaaagaatgatcctcagtgtgctcacggggctgctgttcggcagcgatggctacta

SEQ ID NO: 200638 - DNA, 532 bp, Homo sapiens
  Payload ID: 19598
  Gene Name: Yip1 interacting factor homolog A (S. cerevisiae)
  ENST ID: ENST00000528575
  CDS Start-End: 53-532
cgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccagttctccccggaggtgctgggcctgtgtgcaagcacagcgctggtgtgggtgg

SEQ ID NO: 200639 - DNA, 667 bp, Homo sapiens
  Payload ID: 19598
  Gene Name: Yip1 interacting factor homolog A (S. cerevisiae)
  ENST ID: ENST00000496746
  CDS Start-End: 371-610
gcatagctgtagcctcgaactgtgaccctggacatgtctcggcccctagtgacctctagcactgctctgttaagagggagcagctgtctccagcagtctcctgaggatctgcgtgccatgcagaggttggggaggtgttgagagtcactctgcgagtcttggggagagaagggggtctcagatccaggtcctggggctgagtcctgggccttccatatccctttggggtctgggtccctgtggggacagattgagagtaaaaggtgctgtgggaggtggggtctagctgggctctgggcgttgggggtagggccaatctcaggcctagacccctgggggtcaccaaccctttcctcctcccacccccagaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 200640 - DNA, 854 bp, Homo sapiens
  Payload ID: 19598
  Gene Name: Yip1 interacting factor homolog A (S. cerevisiae)
  ENST ID: ENST00000471387
  CDS Start-End: 256-732
gtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacgaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgagtctggtgcacccccccattcccctgccttcacttgagggcaaacctccccctcctggccaggcttcagttctcctttcttccaggtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 200641 - DNA, 354 bp, Homo sapiens
  Payload ID: 19598
  Gene Name: Yip1 interacting factor homolog A (S. cerevisiae)
  ENST ID: ENST00000616458
  CDS Start-End: 1-354
ggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccgaagctagggctgctggtcttccctacacacacccagaactgggaagtgcagtacagtcgatgctcctctgcccc

SEQ ID NO: 200642 - DNA, 964 bp, Homo sapiens
  Payload ID: 19599
  Gene Name: Yip1 interacting factor homolog B (S. cerevisiae)
  Uniprot ID: Q5BJH7
  ENST ID: ENST00000329420
  CDS Start-End: 65-964
gtcactgcaggtcagaggtcacgagatcaaggatctggaaccctgaggtgtgcacagcgctgggatgccaggttcggcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtga

SEQ ID NO: 200643 - DNA, 1257 bp, Homo sapiens
  Payload ID: 19599
  Gene Name: Yip1 interacting factor homolog B (S. cerevisiae)
  Uniprot ID: Q5BJH7
  ENST ID: ENST00000337679
  CDS Start-End: 7-882
cgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgtttccccttttgccgggcgcggtggctcatgcttgtaatcccagcactttgggaggccgaggcggtcggatcacgagatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggc

SEQ ID NO: 200644 - DNA, 1225 bp, Homo sapiens
  Payload ID: 19599
  Gene Name: Yip1 interacting factor homolog B (S. cerevisiae)
  Uniprot ID: Q5BJH7
  ENST ID: ENST00000339413
  CDS Start-End: 47-991
cgggcgggcacgctccgaaccgcggcttaggtggcggcggcgaaggatgcacccggcaggcttggcggcggcggctgcggggacgccccggctgcgtaagtggccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggca

SEQ ID NO: 200645 - DNA, 1404 bp, Homo sapiens
  Payload ID: 19599
  Gene Name: Yip1 interacting factor homolog B (S. cerevisiae)
  Uniprot ID: Q5BJH7
  ENST ID: ENST00000392124
  CDS Start-End: 316-1167
gtgggagggtgggtagatggataggtggatggatgggtgggtagatgaatggatgcatagatgaatgtatcagtggatggatagttggctagatgggtgggttggtggatgaatggcagagcttgcacctgccagtccatctgacatcaaagccagtgtctctaatggtgacaccaccctcctctgcagcaggaggcagagctgtgggatgaatgaggttcgccaggtctcccttacctatcctgggtccccagctccttctcactctcttcccttgcagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatgg

SEQ ID NO: 200646 - DNA, 940 bp, Homo sapiens
  Payload ID: 19599
  Gene Name: Yip1 interacting factor homolog B (S. cerevisiae)
  Uniprot ID: Q5BJH7
  ENST ID: ENST00000591784
  CDS Start-End: 89-940
ggcgaggtcactgcaggtcagaggtcacgagatcaaggatctggaaccctgagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtga

SEQ ID NO: 200647 - DNA, 466 bp, Homo sapiens
  Payload ID: 19599
  Gene Name: Yip1 interacting factor homolog B (S. cerevisiae)
  ENST ID: ENST00000587039
  CDS Start-End: 158-466
cttccaccactatgttttcctgagataagtcggggagtctgagagggagagaaggggggagactgagagtcagagagaggagagactaaggacgctaggtgggcagggctcttcacttgcagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccag

SEQ ID NO: 200648 - DNA, 1077 bp, Homo sapiens
  Payload ID: 19599
  Gene Name: Yip1 interacting factor homolog B (S. cerevisiae)
  Uniprot ID: Q5BJH7
  ENST ID: ENST00000591755
  CDS Start-End: 4-888
aggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgtttccccttttgccgggcgcggtggctcatgcttgtaatcccagcactttgggaggccgaggcggtcggatcacgaggtcaggagatcaagaccatcctggctaacacggtgaaaccccatctctactaaaaatacaaaaaattagctgggtgtggtggtgtgtgcctgtagtcccagctactcaggaggctgaggcaggagaatcgcttgaacccaggaggtggaggttgcagtgagccgagatcgcacacctgcgctccagcctgggtgacagagcgagactccgtctcaaa

SEQ ID NO: 200649 - DNA, 1181 bp, Homo sapiens
  Payload ID: 19599
  Gene Name: Yip1 interacting factor homolog B (S. cerevisiae)
  Uniprot ID: Q5BJH7
  ENST ID: ENST00000592694
  CDS Start-End: 82-933
cacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcgtggacagcc

SEQ ID NO: 200650 - DNA, 936 bp, Homo sapiens
  Payload ID: 19599
  Gene Name: Yip1 interacting factor homolog B (S. cerevisiae)
  ENST ID: ENST00000592246
  CDS Start-End: 36-782
cctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacgactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaag

SEQ ID NO: 200651 - DNA, 575 bp, Homo sapiens
  Payload ID: 19599
  Gene Name: Yip1 interacting factor homolog B (S. cerevisiae)
  ENST ID: ENST00000588002
  CDS Start-End: 1-575
cctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggatgattggcggggtcctcatgggcctgctcttcgggaagattggctactacctggtgctgggctggtgctgcgtagccatctttgtgttcatg

SEQ ID NO: 200652 - DNA, 734 bp, Homo sapiens
  Payload ID: 19599
  Gene Name: Yip1 interacting factor homolog B (S. cerevisiae)
  ENST ID: ENST00000589247
  CDS Start-End: 40-734
atcaaggatctggaaccctgaggtgtgcacagcgctgggatgccagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctacta

SEQ ID NO: 200653 - DNA, 4329 bp, Homo sapiens
  Payload ID: 19600
  Gene Name: yippee-like 1
  Uniprot ID: O60688
  ENST ID: ENST00000339468
  CDS Start-End: 385-744
ctccaaggctgttaacggcgtctgggccgggctacggctccaaaacaaagggcaggcggcccgcggggcggcggcgggaggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaagtcctttcaggggagccagggacgcgcctacctcttcaattccgtggtgaacgtgggctgcggccctgcagaggagagggtccttctcaccgggctgcatgcggttgccgacatctactgcgagaactgcaagaccacgctcgggtggaaatacgagcatgcctttgagagcagtcagaaatataaggaaggaaaattcatcattgagcttgctcatatgatcaaagacaatggctgggagtaatgtgcgaactttcccttctcctttgaatgctgttttgtgaaagaaactgtgaatgtaatggaaacgtaggagcatctggtgacagcctttcttgccctctgacctcaaaggctagctgcgcatagctcttgacactctcggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaagagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccctccaccaggagtgggcaccccataagggtttaggccactttgcagaggatggaggtcaaaaaccactcccagataagtttggttttcaacatttagtaacttgtctcagggcagagggcaggcagggggaccgaggggcagcagataggagagcactgagcccggatagttctcagcctggcaagtggctctgaagctgccttcagacaaggctagtctaggggcaagagtgcgagctggctgacaataagaacgtggccacctgcccagcttcacacctcccccgacttcagcccttcctaaacccagacctgcggtccaggcaggcactgggctgtgcccactcgagctcactgcccacacacagcatgcctttgggtgccatctctttgcccaagcctggaagccttggcaggtgggaaatgccgctgccctggtgggcatggcactgagatgcatccactcagcaggagtgacagaggcagaagttcctttaaagcacatcttccacttaggaaaggaaggaaatctttgtactgtcttggaagcctccacatccggctatggccctgcaagctgctttatccctgcgctagtctcccccgagggtttaggctggcccagcacatcctgtcctcctgagctcgcgtgcagccacccagagcgcaggggtcactgcacgctgcagggctcttgctgccatggtctcaagcctgaagaggctccgcccacaagctggcccatgaagttagcaatgcctgtggcttcagtcaattgtcttgagactgtgaagaggctgaaagacaccttcccgggtggaagaaggagttcactgaaaacttatcttaaactgacccttccctttgagtgagtcttcattcctctcccatgtgggaacccagcctccgatgccccggggactaggggaaacagttggaggttcgtgccgtccccagcctgccacgggtgcgaggacagccaagtcctgagtgactcaagatgcttcacttacatggaagaaacttctaaaactctaccgagtggtttttgtatatactaaagttctatttagagcttttctgttttgggcaagttcgctgctccttctatttgggcactttggtttttgtactgtcttttgtgacggcattgattgaacattttttactagtagtcttatgacttttgtatttttttttttttttgtaatttataccaacaacacttttatcactttttttttgttgggcttctgcaaaatacaagctcatttttaaaccaaatgaacagaccatgagctggcttcaggggaagtgctattcacaggaccatatccaccaccctcttaaattcctaaacaatatcatctaggacttctatttaagttatttaaaataaatcttccttgagagccttgggaggtgatgtcagggttataaatggcacagtgcatttgctgtaggaatgtggtttggcattgttttatacacacagtattttttataccttaatgcttattcttgatggcatctgtcagatattagaattgaaaataagaatcttcccaaaatcctttaatttacctgatgccctcatcaggtcgttaaaaattcaaatggttttaatagctaaaaaactacaaattaagctctaaaacaaacaaactacagaaatgtaaaccttcatttgccaaaggtccttggtggcctgtcccctgccctgggagcagatggccctgaagcccttccctcactgtgcaggccaccgggtgaggctggacggtcacccatggtggcttcactgcaaggagcaggactgccgagctcaagcacggggccttcagcttcccctgtcctctggccacaccgccagcccttggtccttatctgtgtgaggtttacaaataaagcttctgatgtcaaa

SEQ ID NO: 200654 - DNA, 466 bp, Homo sapiens
  Payload ID: 19600
  Gene Name: yippee-like 1
  ENST ID: ENST00000403503
  CDS Start-End: 306-440
ggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaagtcacttgcagaatgttgacgcagcagaatcagccactcctgtct

SEQ ID NO: 200655 - DNA, 5217 bp, Homo sapiens
  Payload ID: 19601
  Gene Name: yippee-like 2
  Uniprot ID: Q96QA6
  ENST ID: ENST00000312655
  CDS Start-End: 319-678
tggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaaaaaaaaatacctcatgactgcattctctctgactagaagcttctgttcctgacaccaaatgtgccaggttagcaaatgagcacaagatgtggccctgattctagttggtggggcaagggcctggttctcctgggctgagtgggggagtgtcctggcagcagcgagtgacctgggcagtggccaggtgggtgcgatgactctgatgcctcactcagtctctgggcaatcatcatctttgcctctagccaccgtagataaggtgtgaagggactgctgtttgcaatgggcttaccatccaaatatcccaaaggctttgaccagcaaccaagtaaaatcagtaattgaggagagcagggcacaaaggggctgcagtttgggagctcctgaagaaatggctcagatattgagtcagagaaataaaaagtaggatcagttagcaattctaactgcccttccttctgacccctcataagaggagtgtggtgagggaggggactgggtaggggtcatcccaggaggaggggtttacattggaaccagttcaggttcggtgcatctttcctcttcggttttacagtggcttccgtgggatcgtcaatttcttgttcttagagtttcgggtgtttttctccagtcttgttactgtagactgtagaaagcacgggccccaggctctgagcttagtaataacctggctggtagattcctcatgcccctaattgtcccacttaggcctgaatgtcttgcatggagagaaatctcctgtcagtgtggtccagcagcagggaggagttctgcccaaattccgatatcaccccttcccccatccaagcatccttcgattagggaagtggagagcacatccctgtaaggcccataagagaaagaggagtttgttacatttaatcaacactgtgaagtctgttctacagcaattcagccattacacagtatatgactgaaactcatttaactgggttaatttcatttcttagactgaatatattattgttaagatacgtgtgcgtgttaggtaattctcagcatctcctccaagtaggccgaccttctcggaaaattcaccctaaaagtctcacaaaagaatgagttcatggggagattctgtaaagtgatgaactgagatgaaagcagccaacagcccaggagcttttcagaatagcgtctgcagcagaaccagtttccattcagagcgcgtccttggtggaaatgcttttttgtgtgtctccacgcgctgatggtggaatgggagccccaagacgtgtgggcttagaaatcaacttttgttccccaaggcttcttgtccagatctttccagtgctttcatagccctgggagatcaagttgttctccccactttactgcaaggtagactgaagttcagaagaaatactgaatttctgctcccagaagaatagtttctctggctcacaggcccaagttctcaatgaaatcgttttttaactttcacattcctaagctggcttcccggcacagaagccatggatttcccctctctcccttccccctcctcaaggaaatagtcttcctttatggattttcattggactctttcctcagcgattgtcctggctgtttattgatagtccttcccataagaaaatggggttaaacatggggtaggtattttgtctttcaaactacaaatggaatgtggtgacataaactagacatggggtgccctcaagtttccaaggggaccaatgtgccactgttcttccttggggatgaggcctttgactgttggatggatcagagcaggctccagtcagaccctggttctgaatgttttttttttcggtgactatccagtgagccttcagtgggtgcaaggcgccatacttgctgtgagagagctgagtagagtgttggtttttccataactacagggggaaaaaaagtcattaggctttccctttgtgtcagtgaaaccaaaagtgcttcttacaacgttcgctctgttcatgggttgtctatctaacattgagcagcattggagaggccacagctgagctatggagatgctaaattaactcatggcctcagtcagttcattctttaatttcctcaccaaattattgacttagagcataaccaaagacctcattcattcaccccaggtgggttggggtaattggagtttgttggtgaagtttgggggcggggtgttgggagtagagacagggtaaggggacgtgagaaaggaaaaggcatgaagttctatacctcagccagcagctgccttcgtttggaactgaagtccagccagcagactctctagctccatctcccctgtgccaccctaggtcatatgaccttggccaccttggagtagacccagacccctcgggacccgggacattagtctcaggctgctgatggattgatttgacatgaaccaaacacagccaaactcgatacccacaagctgtcagctgaacctgactgagtgttcttcctgagttcacgaggataggctagagtgcatttttactggtggatcagtgtgtgcgaaagagatgaccctttataaagagattttcaagtggatatatataaaagaaacagttgcttgtaaaatatacttttgtaaataatatttaattttttaaataatatatttggtgctgttttctcagatcccctgagagcactttttattttccttttaaattctatggtttcctttgcatttcttgaagtatattttaagggaaacagtgatcaccaatacatgttttcagttttttttttttttaaggtctctatcactttaatctggatcaaggctttgaagcaatgcctctctgcattttttccccagtggaacagactctgcagtacattaatcaggttgagaattgaaatattttcttgcatcagtattggctagaaaagaaaataaataaaaccaagttaatttagtagtaacaacttacagtgattcttcctgttggaagaatttccaacaaatcagaatcacgtttttagttgtgcgtgtgcgcgcacacgtgtgtaaaaagcactttcgattgtgcctcctgttttctcgagtggggacactttaactacagtttacacctcgggcgcataaagtttttcttctctttctctctggttgtttctgtttctgagtggaccaacagcagaacccacgaggatttgttttgagtatggagctgttgcgggtttgctcctttttcttgctttgcgtgctcagtttttacagactgtaaaggagatgtgttgtttgtgaagatggagcagagtcaaatctgtgcttctaactgagatgagagtgtattaatcacgtatcgcagggctccagctgttttagaagccacatcatgttaaacattaactggtttggattaaaagaacattaatattataatacacatatcttagtggtaaacagctttttttttttaaggtcagattgcctcaggtttagaaagaggctgagaaatcaaatcttgaacacaatcaacttacatattttaaaggaatctgcctcaaatgagaaaatatgctagttatctagatagaggaaagagatatttacttttttaaaaattaaaatagttatgaaatctggcagaaaaggtaaagcctagaagaaactatgaaagctattctcatgttaccaaattctatctgcgcatatgtttttgtataacatttcggtgacagtgggagtcggttccctttcccaacctgcagagactatcttccaatacagaatctgtctatttatgcttgtgtttacaaactgtatttgttgggtttgggtttttgttttctttggtggcatttttcaggtcactttgcttctataacaaaggtaattgttttcaaataatttgtcttcaccttttcctgtatttgtacatagtgattcagtattagagaaaagtgcattgtttctgtcatatttccaatctgtgttggtgctcatttgagaaaataaaagttttcaaatattaa

SEQ ID NO: 200656 - DNA, 881 bp, Homo sapiens
  Payload ID: 19601
  Gene Name: yippee-like 2
  Uniprot ID: Q96QA6
  ENST ID: ENST00000585166
  CDS Start-End: 336-695
ttcggcaggcagagcatcactactacatggaaccaggactttaaaggctgagagaattctagagatcatgtaggattatcatctgacgtataagcccccgaaaccaagactagaccctgcatccagggttgagatgaatggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctcttt

SEQ ID NO: 200657 - DNA, 935 bp, Homo sapiens
  Payload ID: 19602
  Gene Name: yippee-like 3
  Uniprot ID: P61236
  ENST ID: ENST00000398838
  CDS Start-End: 215-574
cgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgta

SEQ ID NO: 200658 - DNA, 1588 bp, Homo sapiens
  Payload ID: 19602
  Gene Name: yippee-like 3
  Uniprot ID: P61236
  ENST ID: ENST00000398841
  CDS Start-End: 719-1192
ggcgcctgcgaacccgggcccgggggggacggcgcccgccaggagcgccccccactcccaggccagcccaccccggcggaccgggccccgcgcgcccaggcgaggtgaggcccgcgccgtcagggctgcgtgtcgccccgcgcccctgcccagcccgcgaggactgccccctcccccggcgcccgcccccacccccgcgccccaggtgagccccggagtccaggtaaggctccgcgttgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggagaca

SEQ ID NO: 200659 - DNA, 575 bp, Homo sapiens
  Payload ID: 19602
  Gene Name: yippee-like 3
  ENST ID: ENST00000565110
  CDS Start-End: 267-575
ctgcgaacccgggcccgggggggacggcgcccgccaggagcgccccccactcccaggccagcccaccccggcggaccgggccccgcgcgcccaggcgaggtgaggcccgcgccgtcagggctgcgtgtcgccccgcgcccctgcccagcccgcgaggactgccccctcccccggcgcccgcccccacccccgcgccccaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagagggg

SEQ ID NO: 200660 - DNA, 669 bp, Homo sapiens
  Payload ID: 19602
  Gene Name: yippee-like 3
  ENST ID: ENST00000570099
  CDS Start-End: 1-95
ggccagccgaggagcgggtgctgctgaccggcctccatgctgtcgccgacatccactgcgagaactgcaagaccactttgggctggaaatattgatcctctaggtagaagctattattatctctacagaagaagacagggaggcccagagatgttaggtaacttgcccaagatcacccaactggaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggagaca

SEQ ID NO: 200661 - DNA, 522 bp, Homo sapiens
  Payload ID: 19602
  Gene Name: yippee-like 3
  ENST ID: ENST00000566401
  CDS Start-End: 212-376
cgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtgtgagtatctggcctcccttcttgctttccctgacctctgttgtgacctgtgacccctggcatcctgctgagactcccagagttccccggtgcaggcaggaaattggtgaacgtgggctgcgggccagccgaggagcgggtgctgctgac

SEQ ID NO: 200662 - DNA, 796 bp, Homo sapiens
  Payload ID: 19602
  Gene Name: yippee-like 3
  Uniprot ID: P61236
  ENST ID: ENST00000566595
  CDS Start-End: 364-723
atctgtttacagcttatgaccaggaaattgagtctttgaagaggaacttagctgtcccaacagaggcatccgagaggcctggaggaggtgatgctggacagtaggaattgcctggtccgacgccctggctgccaggggcgcgcatctttgggtcttccctgctagaaggtgaactgagtgtgtccctggcgctctggcaaaagccatggaatgggcccacagtgagaattccagcttcgcctcttactagctggataacctagggagccgcgagacctccctgggcctcagcccccggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccaccc

SEQ ID NO: 200663 - DNA, 1941 bp, Homo sapiens
  Payload ID: 19602
  Gene Name: yippee-like 3
  ENST ID: ENST00000562641
  CDS Start-End: 531-944
ccacccccgcgccccaggtgagccccggagtccaggtaaggctccgcgttgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgtgagtcacccacctctgaccccaggctagcctttgacctgaccttccaacacctcctcctgacaagctgtcaccctatagcctttcagattgcataggccgagctcacacaagtcagcatccctgaccacattctctttatcttgcaccttgcaaggggtgtagaacttttctcttaacccatcccttctctcccaggcacttggatccccattagagagttaggatataatcagagtcaccatttatggaatgtttatgtgccttgcactgttgtgtgcctggcgtctattatctcattcaatcattgcagtgatcctctaggtagaagctattattatctctacagaagaagacagggaggcccagagatgttaggtaacttgcccaagatcacccaactggtaagtaacagaatagggaccagaatctgagttggttggttggtttttttttttcactccaaacccttggtcaccagcttatattgtcatttagagtatcagaaaaattgccccagactctgcaacaacatggagcttgggttcaccagcctccctttccatagtcctcattgccactgctgctgtccagggtctgatttcactaccctgagtctcatttccttatctctcagtggaagataaagccactgcctagcacccaggattgttacagggatcagattagatgctcaggaagatgctcttgggacactgcaagggacaggattcttcaggcgtcgcttggaactgtggtgcctctgtgaggtggatgtcccaggcagagccagccagccagccctgacctgagctcgctgctgaccctgccacagattggctgtgtgtctctggacaggtggcttggccactctggacctctaccaaataaagagctggccggccaggcacagtggctcacacctgtaatcccagcactttgggaggccgaggcgggtggatcacaaggtcaggagattgagaccatcctggctaacacggtgaaaccccatctctaccaaaaatac

SEQ ID NO: 200664 - DNA, 761 bp, Homo sapiens
  Payload ID: 19602
  Gene Name: yippee-like 3
  ENST ID: ENST00000566134
  CDS Start-End: 141-368
ggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgta

SEQ ID NO: 200665 - DNA, 730 bp, Homo sapiens
  Payload ID: 19602
  Gene Name: yippee-like 3
  Uniprot ID: P61236
  ENST ID: ENST00000563788
  CDS Start-End: 238-597
agaatctgtttacagcttatgaccaggaaattgagtctttgaagaggaacttagctgtcccaacagaggcatccgagaggcctggaggaggtgatgctggacagtaggaattgcctggtccgacgccctggctgccaggggcgcgcatctttgggtcttccctgctagaaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatata

SEQ ID NO: 200666 - DNA, 1721 bp, Homo sapiens
  Payload ID: 19603
  Gene Name: yippee-like 4
  Uniprot ID: Q96NS1
  ENST ID: ENST00000300022
  CDS Start-End: 445-828
agtgttatgatgcagttccacaacacacagccacattcacccacagaccgaggtacagaacgagagacaacctctgcccccccagcagctggccagctttgcagccccagtcttgagcccccaactaccctccccccacccacccccatccccttcccaattgaaggagcggaaagagaagagagaagagtgagcagagagattgagagattgagagagagagagagagatagacggagatctctggagcagacctcaaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 200667 - DNA, 889 bp, Homo sapiens
  Payload ID: 19603
  Gene Name: yippee-like 4
  Uniprot ID: Q96NS1
  ENST ID: ENST00000534711
  CDS Start-End: 318-701
ccgactccctggctttggcgccagaagcctggatcggctgccaggtttgccagagcagaatggggatccaggggacagggcgacaatgcaactggatgctgtgggggggtcgatggtgatggggaaagtagaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggg

SEQ ID NO: 200668 - DNA, 4000 bp, Homo sapiens
  Payload ID: 19603
  Gene Name: yippee-like 4
  Uniprot ID: Q96NS1
  ENST ID: ENST00000524669
  CDS Start-End: 2724-3107
agtgttatgatgcagttccacaacacacagccacattcacccacagaccgaggagcggaaagagaagagagaagagtgagcagagagattgagagattgagagagagagagagagatagacggagatctctggagcagacctcaaggtgagggggcagcccttctccaaatgaatttttttctctttgcaaatttcctcctcctgctgcgtgttgctttctcccctttgcaaaagcattattcatccaccctttgtcctcccttccccctccccgctgcctccgctcctctctctcggttcctccatccctctccaagctctgacgattcccgcacttatttcccggcaactttggctgcagcatcaggcatcactgtttattgttttgctgctggtgcagacccccaaagcctgccctgggagctggcggtgctgctaattatttggaccataccatactgagaataccagcctggggggtgccaaaacctcagagcagatgagaaaatccattgtgagcaggtgtccccccccttttcttttcccccctgagaagcacgagattcgcacctggttcctccagcctccgcctcggcgcctctgctgtcagctgtcagttgcccccgccagccctccctctcccctttctcctacggtccagccccgtctcacttcaggggaacatctctccccagcactcggcttgcctttgttttttctccagtcatttgcccaacttgcttctccctgtgatccgagatgggtgaaaaaatgacccctactcccctttgtgattctctggccttctgtgcagcctttccttggcttgactgggaattaggggagagggagggaggcgtgacggccggaggctggagaaggagctcaggattggggacccaagctgccccattctccatgccccttgaagaaggtgtttcaaggtggtgcatgtcagaggggaactcgctggcaaagttgaaggcaaacctgtgaagcagagactgaaaggtggtctcttggcaaggagggcccgtttcctgcagccggagcccaatgtcaccctgaactcagcccaaggtgtcttcctgggacccagcccggaggagaggacctgaaactgaagatagtctctatggaggttttgcggagagactgcctggcggccttcagagagagtggaacagctgggtgcctgtggccactgcggaggacaggacgaggagagcctgtatgccctggctaaccagagccaacactgcctcttctctgcttagtgctctagcattgccagagtgcccagctggcatctctgaaccagacttaggctaaccacccacagtgggctgggaagccctatgaaggagaaagcagcagctcacctgcttatcggagccaacaggggccacctcccttcttatcctctgcctccagcaccttcagccactcggaggctggcgcgtgggcagaaggcaatcttcctctattcctaatcagaacccagcaattacttcatcttcagtcacccacagagtcactgctgtttgtccctgcccctgggagaaggtagaaagaaacattttctgccttgtgccccaaagcacagctgttaaaaataagagtcccccttctgctgttcgttgtggccgttgctctcaccctaccacacagccctgcccagcccaggaatcaggctcctctgacatgctacccatttcccattggctccagctgtcagattgcctgaagaaaatgtattttctgcctaagtctttaaccaagggctaaggcaacagttagtaaagactaggagagagaaagaccaaggggcccacaggctgggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacaccgactccctggctttggcgccagaagcctggatcggctgccaggtttgccagagcagaatggggatccaggggacagggcgacaatgcaactggatgctgtgggggggtcgatggtgatggggaaagtagaggtatgggtgagctgattcccttttcctccattccctcaggaggggtcctcctgaggtcgcagctcccctgatgtcctttcccctcttcccaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 200669 - DNA, 561 bp, Homo sapiens
  Payload ID: 19603
  Gene Name: yippee-like 4
  ENST ID: ENST00000534810
  CDS Start-End: 321-561
ttcacccacagaccgaggtacagaacgagagacaacctctgcccccccagcagctggccagctttgcagccccagtcttgagcccccaactaccctccccccacccacccccatccccttcccaattgaaggagcggaaagagaagagagaagagtgagcagagagattgagagattgagagagagagagagagatagacggagatctctggagcagacctcaagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccact

SEQ ID NO: 200670 - DNA, 1638 bp, Homo sapiens
  Payload ID: 19603
  Gene Name: yippee-like 4
  ENST ID: ENST00000532314
  CDS Start-End: 405-572
ccacagaccgaggtacagaacgagagacaacctctgcccccccagcagctggccagctttgcagccccagtcttgagcccccaactaccctccccccacccacccccatccccttcccaattgaaggagcggaaagagaagagagaagagtgagcagagagattgagagattgagagagagagagagagatagacggagatctctggagcagacctcaaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttga

SEQ ID NO: 200671 - DNA, 2182 bp, Homo sapiens
  Payload ID: 19604
  Gene Name: yippee-like 5
  Uniprot ID: P62699
  ENST ID: ENST00000261353
  CDS Start-End: 127-492
gccagggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 200672 - DNA, 2499 bp, Homo sapiens
  Payload ID: 19604
  Gene Name: yippee-like 5
  Uniprot ID: P62699
  ENST ID: ENST00000379519
  CDS Start-End: 444-809
cagggagaggcggggccaaggccagggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgctttggtgaattcgtttcctgaaagtttatcgcatacttgtactgggttaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 200673 - DNA, 2560 bp, Homo sapiens
  Payload ID: 19604
  Gene Name: yippee-like 5
  Uniprot ID: P62699
  ENST ID: ENST00000379520
  CDS Start-End: 505-870
cagggagaggcggggccaaggccagggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgctttggtgaattcgtttcctgaaagtttatcgcatacttgtactgggttagccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 200674 - DNA, 2197 bp, Homo sapiens
  Payload ID: 19604
  Gene Name: yippee-like 5
  Uniprot ID: P62699
  ENST ID: ENST00000402003
  CDS Start-End: 142-507
ataccagctgaagagcgacaagccgctggcagccgcggatctcaccgccgctcaggagatctgttggtaatctgaggatttttattctacgtcgtcttgacagatggaaaacctgaagtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 200675 - DNA, 1735 bp, Homo sapiens
  Payload ID: 19604
  Gene Name: yippee-like 5
  Uniprot ID: P62699
  ENST ID: ENST00000402708
  CDS Start-End: 662-1027
tcgcatagtcgggggcgcgcccggtctccgccccgaatccaagtcggaacttgaccgagttgtttgggccgcgatgaccgcacggcgtgaaccgtcctgagcagggcccacgcccggcccaagcggcccagccaccgggctggggcggtgtctccctttgccccctcccccccatgaacgtccgcctcccccgccctcctgcccagaggacccgggactgacagcgcagggtgacggttgggcagcccgccgggtgtcgggaccaagagagccccccggccacccgctcagctgtttcctgctcgtgtttgttgtgccgagggaggccccgccgccaccgccgccgccgcgctctgccgccccggtccctcccgattggccggctggcgtcacgtggcctccatcagctgggccggcgggggcgctcgcgggccccactgcggctgccgggtgagcccacccgggggtcgcccgggccggcccagctccgccagcttcgggctgcggccttccctccgcttgcagtcgggagggtgggcgtgcccttgcaacccctttcctgtaccttctctgcagccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttgga

SEQ ID NO: 200676 - DNA, 878 bp, Homo sapiens
  Payload ID: 19605
  Gene Name: YjeF N-terminal domain containing 3
  Uniprot ID: A6XGL0
  ENST ID: ENST00000436027
  CDS Start-End: 73-822
cctccctccacggatgcgcttaaaaggcggtggcggtggcggcagcgcccggcgcccgggctcacctcggccatgagcagcgcagccggcccagacccgtcggaggcgcccgaagagcggcatttcctcagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccaccac

SEQ ID NO: 200677 - DNA, 995 bp, Homo sapiens
  Payload ID: 19605
  Gene Name: YjeF N-terminal domain containing 3
  Uniprot ID: A6XGL0
  ENST ID: ENST00000514277
  CDS Start-End: 39-938
ggtggcggcagcgcccggcgcccgggctcacctcggccatgagcagcgcagccggcccagacccgtcggaggcgcccgaagagcggcatttcctcagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccaccacc

SEQ ID NO: 200678 - DNA, 2785 bp, Homo sapiens
  Payload ID: 19605
  Gene Name: YjeF N-terminal domain containing 3
  ENST ID: ENST00000458210
  CDS Start-End: 52-348
aaaaggcggtggcggtggcggcagcgcccggcgcccgggctcacctcggccatgagcagcgcagccggcccagacccgtcggaggcgcccgaagagcggcatttcctcagcaccgcggaggcagccgccctggagcgggagctgctggaggattatcgctttgggcggcagcagctcgtggagctgtgcggtcatgctagtgccgtggctgtgaccaaggtggggaaactgaagctcagaggtggcgaggggcctgccctgggtcagagggggatggaagcagagctgcaacccaggtgtgtctggctctggagtaaacccccacacctcgaggggccaggaggatgacacaagggtgatagcaataatcatactatggagtgcttcaccgtgcagccagcagtgctgggcatcagtttcctctgcaacagcataataaatggtactgacgagtcagtccctaaacgtgaacgcctcagaaaactgtcccatacagtcgaggctctagcgtgactgcctcctcttcctcccctgccctcctcatccccctcgcctttctcctccttcctcctcctcctgccccctcctcttaccctcctcctcctttctctctccctcctcctccccttccgcccctttcttctctcctttctccttcctctccctcctcctccccctcctcctgttctccttcctccttcccacttaccctacctcctccccatcctcctcctccccattctctccctcctcacccctcctcctctttttcttcttattaccacggtatactttttaaaaactcaatgtttttcttcatgtggacttaaatgtttgtatttccaaatgaaatagatcccgggtgaggcgcccaaaggagaaggaaaatcaaaaccccagaaagaaacccagtagtcactactcgcctggcgctcagtggccaactgtctggtttttgcactgaaagccccttgtctgtccagaagcccctcagtcccagtcttgggtcttgggctctgggcccggtgtggctgggatcgcaggcatgttcatggcaggtcaggactgcgctaagcctttggggaggatacttgaaaggggagtaatctgctgtctgtgtggttggagcttaaagtacagctggggctcaagagacacccagagtgcctgtcaggcggtggcactgtcatcgcatttgataaaggccaaactgagtctgggagagaaggggctggggccacgcagaatcagggcagggctggggccaaaatgcctggagagacagagtctgagagatacagagatggccagagacagatggagagagacagataacagagagatacagagacagccagagacaaatggagagagagacaaatggagaaagagagccagagacatacagaaagacagagacactagagtctgagagatacagacagacacagagacagccagagacagatggagagagacagagacacaaagagagccagagacacagagagtctgagagatacagacagacacagagacggccagagacggagagagacagagacagacagacagagacacagagagtctgagagatacagaaacagccagagacaggtggggagagagacatgaagagagccagagacatacagagagacagagacacacagagagacagagacacggagagtctgagagatacagagagacacagagacagccagagagagacagagaggccccagggcatcgtggctaaggttgggctcccctactccacagcctccaggaggggctgaggtctggaaacatgggcgggggtgggcccgcggtgagaaaggtggaagaatgtctgcaactcaggcggagaataaacaaaccgcactccgggcgacgggcagtggctggatgcacgtttttcctgcaccgacctggcagagcctgagaccgggcctctgcatctccagcggggaaactgaggccccaagaggcccaacccctcatccagaacagctcacctcctgtcctatcctgttgcctccaggcccaagccccatcccttcccctactccgggcctcagtttcctctccaggcaaggaggaatctggactgtgcctgtgcctttgctgtgtcccctaccaccaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccacc

SEQ ID NO: 200679 - DNA, 2696 bp, Homo sapiens
  Payload ID: 19606
  Gene Name: YKT6 v-SNARE homolog (S. cerevisiae)
  Uniprot ID: O15498
  ENST ID: ENST00000223369
  CDS Start-End: 88-684
gcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttca

SEQ ID NO: 200680 - DNA, 673 bp, Homo sapiens
  Payload ID: 19606
  Gene Name: YKT6 v-SNARE homolog (S. cerevisiae)
  ENST ID: ENST00000424864
  CDS Start-End: 1-90
ccacgagaagctgatcccatgactaaagtgcaggccgaactagatgagaccaaaatcattctggttctgttccatccacttggacagtaactattcttggaccgagtctcgacacctagaggtgaagtttgtgtgtgttggagaggaacccagcacaacaccatggagtctctgttagagcgaggtgagaagctagatgacttggtgtccaaatccgaggtgctgggaacacagtctaaagccttctataaaactaaaatatttaattgacaaggatgggtgctgctgactgccgctttctctcaggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagcca

SEQ ID NO: 200681 - DNA, 1270 bp, Homo sapiens
  Payload ID: 19606
  Gene Name: YKT6 v-SNARE homolog (S. cerevisiae)
  Uniprot ID: O15498
  ENST ID: ENST00000496112
  CDS Start-End: 169-663
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgcta

SEQ ID NO: 200682 - DNA, 7108 bp, Homo sapiens
  Payload ID: 19607
  Gene Name: YLP motif containing 1
  Uniprot ID: P49750
  ENST ID: ENST00000325680
  CDS Start-End: 125-6565
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagcatgggcccttttctcttgttttcttaattttatttttaattgctttttaaatatggtatgtcctaattaaatgctagctgaacatcccaaaa

SEQ ID NO: 200683 - DNA, 4899 bp, Homo sapiens
  Payload ID: 19607
  Gene Name: YLP motif containing 1
  ENST ID: ENST00000552421
  CDS Start-End: 125-4447
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagca

SEQ ID NO: 200684 - DNA, 2316 bp, Homo sapiens
  Payload ID: 19607
  Gene Name: YLP motif containing 1
  ENST ID: ENST00000547879
  CDS Start-End: 1-1401
aattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactggtaggagacagaccaaccactttgaacagtgtctctttattaaaattcttaaagaaggtttaaattcagatctgtggttagacaactactgttgatatacactttagtggtaaaagtttccataatcatcttcaaggagacttttggatactctttatttttccccagaccaaaagaaccctctaatgtggtgttaagagaaagttttaacagagtgctaagaaacttacccttgtactcatctatttgtgggtggttttaggggagtataccttttaagaaaatcaattacatatgaaagggcattcttacattccagcagatatgtggcacagcctacccaacatatgcataattgtctcttctttgctacaagatctccaaatttgagtttctgtcaacagaggcagaagaacttattgaatggggaggcagagggttgccactggctgctagatttgttcttctgcattttatcctaagtgacggggaaaaattaaatgactgtgtaggcaatggattttgctcaggctgattagaggcttacatagtgtgagtttaaagtttctgtgtacctaatgtaaaatgctttcgatcacacctctgtagagatgtttgcctttccctgtcattcaagaatatgcgacctatagagttacgttgacttttcagtgtttactgaagtacagagattagcaatgccttggaatagtgttgctttttaaatccagaatattactcggtttatttaatacttgagcccttgctaaagttgctcctcatattcttttgaaaatgtacaaaatgagaactctgattcctaccccctagagtatacagaatctccagggagtggtcccatcgaacccgtgtgtgatatagaggactcttgataaaaactgtgtttatataaagatggtgtcaacctctacattccaagatttcaaatgtggattaaaaaataagttttaaagttaa

SEQ ID NO: 200685 - DNA, 5500 bp, Homo sapiens
  Payload ID: 19607
  Gene Name: YLP motif containing 1
  ENST ID: ENST00000549293
  CDS Start-End: 1-4788
tttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagca

SEQ ID NO: 200686 - DNA, 4424 bp, Homo sapiens
  Payload ID: 19607
  Gene Name: YLP motif containing 1
  ENST ID: ENST00000554107
  CDS Start-End: 1-331
gagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactggaaggatctgagtctctccctgcggagacagccctgaagaactcctgtaacgtcaagctggcaatttccaagaagcaatctggaacctgcatttccaaagagacccacaagaaagaaaagacgtgaggttgggaagcactggtgccagagccctcactagcgggtgctgcctgtttcttgggtagtgggctaggagcatccctgctctagtggcccctgattctgcaaccctaggactcctctgcttcctcatcagacacaaaccttgataagacagctccagtgagaaagccctgggagaaggtgaattaaggacacttcctttgtaggaggagctgatctcgctaatgggcgactttttaactaagcaggtcagaaaatcttactgaaagtaaatctgtggctcaaagagacttcggtattcttttccctagtactaactgtggaaaggagtgcccccaagcttctgactgtcatacctcattccactgccttttagggctgggtctgaagagcttacactcctgctttcagagctggttgacgggggtgctgttctagaatcctaacccagactggcaccatgaatgatgggttgccccactgccaagctccagacccagcttggcttggggcttgctgccactgcaggtcaaatgaccaccctatgtggaaagatgcagcagtgctgcctgtcccatactggccgtgaccccttgagcctcagaaagggagacatggacaattttccccacaggtagtcttagctttccaaacatactctgactcaccagtcaaccagtggatgaccacagttcttgtattttttggaggtatcaataaaccactctttgtgatcacagtcaagggagaagtcaagaagagggaagtgtaatctgtgaccagatatacccggcacctgcagaatcagatgccagcctaacagctgtcagctgtgcatgaggcaacatgcatctcttgattaggaatgtgcgccagtgacacctaggctcacctttcactgacgctttacctctgaggtgccaccagtgtgccttcatagggatccccgagggactgagcttgagtgttgtttattgttatttccagaaaggatttgaggtgacttgctatggaaggcccactgatacattttcaagggaaaatacagataagaatcaaatcatgaaaagcatagaaattgttgagaaaacctaggccaagactaggtgccacaactgagctcagcattcagtcctgagcctcctggcactaaggcaaaaaggtcaggaagttatgtaacttgataatgacagggtattcagtctaagatggtgtaacacctggcagccctctcactaagcttcagaatgaagactggctgttgactcagtttgctgcttccacctgttgcccaagtgaagatgttgaggctgtaatctttgtggatgatacagagattggcccaggctgccctggctctcagtaacttaaggagacacagaagagggatctttcctaaaactcgaatcatatagggaagacactcatcagatctcatgggaacccagtacatggtcttacctcaaagtcatttcccttgttgtagtgcatattgagagcttgaaaaagttctgaattgcggagaaccaccagcattttgggatttgtgacaccatctgaaattgcttgccgggcagatttttccatttggatgtaataaaactcacgaaagttgctgaaccacttgatcatctgggaggtaatgcagcggttgaactgtacaaacaagaggtccatccagtcagacatttgccacgaggtgctcagaattagaactgtctgcttccagctcagtataggggttcatatacggctttaaccagcattaacaggggcttcctttaaaaaaagaagcgaagccaccgctattttccaagcctatttagttatactcagaaaaatctaaattagctacagtgcccattagaacataacttttttttgatatgctagatttatgggggttgttttacccatgaaaagctttttgtggtgtttgagtgggacttaggggtcacgaccagtgtggtgccagattttgctgcacccaggtggactgcatggcaggcctggggccttccacttggataaagggccaagggaagggcaagatgtaggtcagggagcagtttattagcaactttgaattgtggaatgaattgaaatcaaaatcagaggttgcttcagggatcaaccaaccaactgaatatgagggaaagaaaagcttgaatgatgtagaccaaaagtattaacagcccctaacccaacacccaaagtaaaagaggccctcagaaaccttttatgggaacaggggaggtctggtcccaacaattagtttgattttccttattgtcacacttcatctgtatgtactttcactcagttttgaactatagcaatttgaacataaatttgacagtgtctgacactctgtctctctctccctctctatatatattttttgttgtttgtttgtttgtttttgtgtgtttttttttttttgagatgtagtctcgctttgtcgcccaggctggagtgcagtggcgtgatctctgttcactgcaacatccacctcctgggttcaagtgattctcctgcctcagcctccgagtagctgggattacaggcgcacgccaccacgccagctagtttttgtatttttagtagacatggggttttaccatgttggtcaggctggtctcgaactcctgacctcaggtcatctgcccacctcggcctcccaaagtgctgggattagaggcatgagccactgtgcctggcctatattttatttttcatagtgtccccagccaaggcagaaaactagccaaaaaggccactaactagtgtttctgtttccctctacttttcctgcccatgtgtttctgttttggggattatctacagctcagtagcttaagaatttagacagccagcctttctagcctaaagttattcacggttatttgggtagagtctcagcccagaactggacattgcttccatcagcaacactaaggggagcttgaagtgcacatatgatgacctaggacttgcctcacaccaggcaaaacacactgcctcttgggagttctgcagaagctgccatttagttgagtgactttacctgaacatcaggaaaataaaccttcaggaggttggagctgggatatcgtgtgaagaaaaacattagtttggccttcttcaagtgaccagggtttagaccctcctggatttatctcagtgtcaaggaaaatgaacactttaaaatgccagtttatcaattaactagtgaattccttgttcctgtggtttctatttgatttcattttgtttttctgattggaattgtgtatttgctccatttttctgtctctggaaactctggtcaaataagctggatgacatatgtgcacagttaagtcacagaatgtaaaaatcatctcgatgtggaaaagttatgtagcatagatgatgtcaaatacaggttggtgtattttgtgtgtgtgtgtgtgtgtgtgtgtgtgtgtggtgtcttagatgtcaaatacaggttggtgtattgtgtgtgtgtgtgtgtgtgtgtgtgtgtgtgtgtgtgtgtgtggtgtccaagtgggatgggaagagatggcaattctatcccagataaaccatttcaaaaccccaagcagagatttacttcccctctctgcctcagtttcctcagctgtaaaacgagaagagtaaactaggtggtccccattctggctgtcactcttatcattgccttcacagtgttgcctttataaccagcaaacatctaagcaggctgaataccagctcatattttgctcttgctcaagaagcttgaatggttgggtggtacccactctccatttgcctggcagaactatccctcatctttcaggtctcagctcagaagctcccacctctgttaaacccttccttgccaaattaggccttccttaccctgggctatgaagactctttgtacaaactgttgcagcgatgaccttattggaatttttactgtatgtttgtctcgtctagactgtgagctccttgagagtgaggaccttatcttttcatctttgtgcctagcccagtgctaggaacatagcaggtgctcaataaatatttgttgtgtgaagga

SEQ ID NO: 200687 - DNA, 3994 bp, Homo sapiens
  Payload ID: 19608
  Gene Name: YME1-like 1 ATPase
  Uniprot ID: Q96TA2
  ENST ID: ENST00000326799
  CDS Start-End: 150-2471
aggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 200688 - DNA, 2517 bp, Homo sapiens
  Payload ID: 19608
  Gene Name: YME1-like 1 ATPase
  ENST ID: ENST00000375972
  CDS Start-End: 147-2369
ggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaac

SEQ ID NO: 200689 - DNA, 3856 bp, Homo sapiens
  Payload ID: 19608
  Gene Name: YME1-like 1 ATPase
  Uniprot ID: Q96TA2
  ENST ID: ENST00000376016
  CDS Start-End: 183-2333
ggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 200690 - DNA, 986 bp, Homo sapiens
  Payload ID: 19608
  Gene Name: YME1-like 1 ATPase
  ENST ID: ENST00000396296
  CDS Start-End: 241-986
gtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccagtactggctaacaaactgaagcagctgcttgttattgggcatcagttatgtaccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccattttt

SEQ ID NO: 200691 - DNA, 775 bp, Homo sapiens
  Payload ID: 19608
  Gene Name: YME1-like 1 ATPase
  ENST ID: ENST00000427324
  CDS Start-End: 17-775
tgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatgttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggg

SEQ ID NO: 200692 - DNA, 3474 bp, Homo sapiens
  Payload ID: 19608
  Gene Name: YME1-like 1 ATPase
  ENST ID: ENST00000477432
  CDS Start-End: 1057-1467
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactcgggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctgtacactgcgggtttctccaaatgcctattgtctatgatttgttttgtccatcgttcttagtcacggcttagttcaggttcttgccatctttcacttgttccatcagccttctctctcatccagtctagtttctttgtttgtttgttttatcatttttaaattttttgtaaagacagggtcttgctttcttcaccaggctgatctcgaactcctggcctgaagcagtcctcccacctcagcctctcaaaagtgttgggattacaggctcgagccaccatgctaggccagtctatcttccttagttctccattttcttctataagacagaactaatcatgttacttagagaattaaattcaaacatggctcttcacagtttggccataacctatctctttaattttttctttccttgaattttttgagatattccagacccttggatggctttttgtttgcccccgtccctaagccgccttgatcatttttaatagcttaaaaagtacttttaagtattttatttcatcatgcctttaactgtcttttactatgtgctgtcatgttgtatgctaggatacgtagatgagtaaggcatgatctctgcctttgatccttactattaggaaataaggtgtattttatagttatgttagtattgagaaaatgaattctaagaatatgagttatagctaatttaaaaagtaccgtattcccagacatcagtccagagctatataatccgtgtccatgcctcttttaaaaaaaactttatttttagagacagggtctcccctttgtagcccaggctgaagtgcagtgatgctgtcatagctcactgcaacctccagctcctgggctcaaacatttctcctgagtagctggtgctgcgggtgcataccaccatgcccagctaatttttaaatttttcatcaagatgatgtcttaccatgttgctcaggctggtctcaaactcctggcctcaaacgatcttcccaccttagctgttttgggtttgagtaacatgtaattgttacttgcctttaagtgcctctctttcagctcatgtggacaagaaaataatccctatcctgttgtttaaaagtgggtatacacacatttttgtgatttttagacttttttgcctgattttcacacagttttgactttaattttcttctttattagaagatatgggtaactttagaacctctgagttcaaggaaggatctaagcaatgaggccagaggagtgagatgtcctatggtaaccaagcataccatttctttgtcaagtgggcttttgtttatggctgcttaggggcttaaaagctccatggactggtgaggattatcatttgaatggaatttccccaattcaagaaccttactattatcctccaatcagttctacactgttggggaaaatcccctggaccttatataacatactttgtaaccctgcagttagttactcttacactcttgtcattataaatgcttgatcaatagttgatagactagctcttgatcagagtacccttgtatggagagaaggaaaaaatgccatacatttcacttgattctgtgaaccataatgcttaggacagtagtggtttgggtttgatttaaaaaaaaaaaaagtttttctcattcatgctgaaatgtcatctctttatttaaggataccattaggaatataattttttaacctatgtcaaacctcatatgactgatctcagtaaaacgaactgtgaaaatatttgcatcaatttatttttaaatattaaaaaaaggaaatatatttgttagacttttaaaatctgattgttttaactgataatatgtactccttaggttaaatatcttgataatattaatgcatacctggttgacccaatcttttacagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtatgttaa

SEQ ID NO: 200693 - DNA, 912 bp, Homo sapiens
  Payload ID: 19608
  Gene Name: YME1-like 1 ATPase
  ENST ID: ENST00000491542
  CDS Start-End: 183-912
ggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatcttttta

SEQ ID NO: 200694 - DNA, 4127 bp, Homo sapiens
  Payload ID: 19608
  Gene Name: YME1-like 1 ATPase
  Uniprot ID: Q96TA2
  ENST ID: ENST00000613434
  CDS Start-End: 211-2262
actgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatgttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataatttaagctgtatatggtcttcattgaaaaaagatagatattgttacaggaagcttgttacattatattcttgaccttttggttgataatcttaaatcttaatgtaatttcaaactggcagaaatgttgccagcataatacatggatgtctcatataccctgcatccagatttaccagttgttatcattctgcccgttttttattgccccaaacctgttctgtctccctctctgtatgtacatacatacacgtataaaatattgataaagtcttatctgtcttaaatttttttacatatttgttgaggtataatttacatatgataaaattcattttaaatgt

SEQ ID NO: 200695 - DNA, 6265 bp, Homo sapiens
  Payload ID: 19609
  Gene Name: YOD1 deubiquitinase
  Uniprot ID: Q5VVQ6
  ENST ID: ENST00000315927
  CDS Start-End: 48-1094
ccgcaccgaagcgtcgcgataactgcaaccacccgcaacttctcgcgatgtttggccccgctaaaggtcgccattttggagtccacccggcgcctggtttccccggcggcgtctcccaacaggctgccgggaccaaagctggccccgcgggtgcctggcctgtgggcagccggaccgacacgatgtggcggctccgctgcaaggccaaggacggcacccatgttttgcaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcggggggaatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattgtaaatccttgccttatgcagctttctcagaattctgcttcttcctagtactagatgtgtagccatttgcttagtggactaatccgcaaggcacaccctctaaaacttagcttcactacaagatcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttggccctctagggatctaattaaggacattaaagtacaattcttgagctactaaccatcagctcttcttaatcaaagattgccatcagtgtagagtgtatctattggcacaacattctggtgttttgataacagtagaactcaatttcagtaactattaggagcatggtctgtgccctagcattaaaaatgttacttattattatgtgaatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgcctttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgt

SEQ ID NO: 200696 - DNA, 6291 bp, Homo sapiens
  Payload ID: 19609
  Gene Name: YOD1 deubiquitinase
  Uniprot ID: Q5VVQ6
  ENST ID: ENST00000367084
  CDS Start-End: 206-1120
agactattcggtaggcgtcttgagagcgggtgtgccgggtgacgagaaaatgctgcaaagattaacgctctcattcctgaatcccagcagaacctcattagatccataaatgggaacgctgtatcatccgttgcagtcgtcttgaagaaccaaggaggaaaattgcaccagcaaaaaaaaattgagtcatgaaagatgtgaaaagatggaaacattacatataatttattcagaagcaaagtcttttacagtggaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcggggggaatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattgtaaatccttgccttatgcagctttctcagaattctgcttcttcctagtactagatgtgtagccatttgcttagtggactaatccgcaaggcacaccctctaaaacttagcttcactacaagatcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttggccctctagggatctaattaaggacattaaagtacaattcttgagctactaaccatcagctcttcttaatcaaagattgccatcagtgtagagtgtatctattggcacaacattctggtgttttgataacagtagaactcaatttcagtaactattaggagcatggtctgtgccctagcattaaaaatgttacttattattatgtgaatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgcctttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgt

SEQ ID NO: 200697 - DNA, 1826 bp, Homo sapiens
  Payload ID: 19610
  Gene Name: yrdC N(6)-threonylcarbamoyltransferase domain containing
  Uniprot ID: Q86U90
  ENST ID: ENST00000373044
  CDS Start-End: 6-845
ggcggatgtctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggt

SEQ ID NO: 200698 - DNA, 6232 bp, Homo sapiens
  Payload ID: 19611
  Gene Name: YTH domain containing 1
  Uniprot ID: Q96MU7
  ENST ID: ENST00000344157
  CDS Start-End: 337-2520
tttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcttgtattagttctgtattttaagttaactgtccagttctcccagtggtaaccaactataacatagaaatagagccgctcaagaaaacagtttatgaaataatttttttgaattttttcttgagttacacctggagttttggcctttggaatttggcctttataaacattaggaatatttgaatgtttgatttttttatagtatcaacagttgtactgtgtaccagatcacatagtacagttttacatttaatctatattggcctgaaaagaacaacacaggcactttactcttaaaggatataataaactatagttatactgcattcatattcataccagcatgtagtatctttccctgcattcacagaagttttatttacaatgacaaaactaaagcctgaggatttgttttaaatctgcattgtggtagagaggaaaaagtacttttaaggaaacctgggttctagttttgtcattgtctttaattaaaccggttagtgatacatggtaagtcacttcattggcattttgtgtattcatcagtaagctagacaagatgatagctacagtttaagaatttctgtaaccattatacaaaactggtaggtaatattaaaggtattttcctgaaataataggaataaatactgagcactttgtatgcaatagagactttgtgcttttatatacagactcatttaaatgggctcagagaggctagtaaacttgcccaagattagaaaggtagtaattgatgggccaagattttacccatgtttttatttggtgtttctaaaccacctcatcacttttgaaaaaacagtatataaattaataaatgttttggagatggagtctgtcgcccaggtggagggcagtggcatgatcttggctcactgcaacctcctgcctcagcctcccgaatggctgggactacaggcacccaccaccacaccccgctaatttttgtaattttagtagagatggggttccaacatgttggccaggctggtctcaaactcgacctcaagtgacctcacctgcctcagcctcctaaagtgttgggattacaggcgtgagccactgcacctggcctgagatttttaaacattaacatttccttcaggcttaagcagaggatttttctaaagtgccatccaattagatgttaagttatgctttgtatgttgagcttagtattgagtcgatctattttaaaaagccaacattaagtttttaccaagtatctggcactattctaaacaattctgttggctcacataatcatcactgttttctcctttcctaatttttaaaataaacttaccggaacattgtataaaaaatgcaagatttttttctgtacagaagagtcagtatataaaaatcagtatgttttatttaatattcgtacacatgacagcttttgtcactgtgagaagacatggtttctttcgtgtactccactgtgctgtgattctaacaatctacattagtatgatgtgttcagatgaaaaacagaaaattcagtcattccgagtttagaaatccggtcagggattttattggctggagtaatagttcaaaggagtgaaaattcaagcatgtaatttttggatttgatttcctccataatgatttcctccataatggctttttttcaagcatggtctaatttttcagaaaatggccattatctccaagcttccattgtccatgtagtttcagtggcaggagagagactattttcctcccagtgtccatgtcagttccccaaaaggactgaatagccatgttggttttggagccagccgtaatccaatctgtatttccaaggaaatggggttctttgtctcccagcattgggaagcaagagaggcacatgttatggtcacctctgtgaggattacatcaggaaggacagtctccaaaagacatggacagaggaaatttagcagatgtccattaaatcaggatctcatacaagttataacacctgaatgtttgacttttcagagtattttgccatcacaggtgtggcatcttgcccttggatatatctacattctgctgtagaatgtcgtggtctttctgagggtcacatacatcctgtcttgtcataatgttaaccattaagagtcctcaggggcatggaattgaagaaggaactgttgccagcagttaactgaccaagctagagttccctgacccaacgtaagggtgactgtgacacacatggataattttagcttcatgtttaagattttgttatttgggtaggaaacattccaaatgcagtttgaaacacatattaaaattgaggcacacaggaaagaactggctcaagtttagtccccaagttccttatagtaggaataggaatccttagagtataagcaatccatgcatagtattctgttatctatcatgtagatcatttaatctctaattttttggggtggggattctcttgtttctaaatcttacactttcagtttcttctgtgtcttaaatatagattattgactattgtcttaaatactaataaatacattaaatgtatcttaaatacta

SEQ ID NO: 200699 - DNA, 3244 bp, Homo sapiens
  Payload ID: 19611
  Gene Name: YTH domain containing 1
  Uniprot ID: Q96MU7
  ENST ID: ENST00000355665
  CDS Start-End: 337-2466
tttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggt

SEQ ID NO: 200700 - DNA, 689 bp, Homo sapiens
  Payload ID: 19611
  Gene Name: YTH domain containing 1
  ENST ID: ENST00000507529
  CDS Start-End: 1-281
caggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtagtaagtgcacaaggaggcaaaggtgtgagggaactacttagaattctgtaggtaacttaaatatggggagaccagagtatgatgattgacggaccattgcatattcttactgcagactgttttggaataattgtttgtttttattaaaaatgcctgattatgcccctttggattatatagatagaatatatttcttttactgatcaaatcacaaactgcttaaggcaaacgcctacaaatagaactccttttaggtagtacctaggctatgttctttccatattgagatcttaattatgctatgtaattaatattgttaatagatatttctgaactttttgtgtattcttactcaatttttctaggatagatcgtgtatattaagttagctgataagctgtaatctcatttagtcatttgtttttatttctaccaaatgttaaagctagtaactgataa

SEQ ID NO: 200701 - DNA, 515 bp, Homo sapiens
  Payload ID: 19611
  Gene Name: YTH domain containing 1
  ENST ID: ENST00000510746
  CDS Start-End: 478-515
agcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagaagactagactcttccagctggttgttttcagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgt

SEQ ID NO: 200702 - DNA, 265 bp, Homo sapiens
  Payload ID: 19611
  Gene Name: YTH domain containing 1
  ENST ID: ENST00000505251
  CDS Start-End: 154-265
ccctattaatttttaattttatttgcagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaag

SEQ ID NO: 200703 - DNA, 2983 bp, Homo sapiens
  Payload ID: 19611
  Gene Name: YTH domain containing 1
  ENST ID: ENST00000579690
  CDS Start-End: 1-2208
atggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagtttcacaaatcttattcccaacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgac

SEQ ID NO: 200704 - DNA, 6232 bp, Homo sapiens; identical to SEQ ID NO: 200698
  Payload ID: 19611
  Gene Name: YTH domain containing 1
  Uniprot ID: Q96MU7
  ENST ID: ENST00000615500
  CDS Start-End: 337-2520

SEQ ID NO: 200705 - DNA, 3244 bp, Homo sapiens; identical to SEQ ID NO: 200699
  Payload ID: 19611
  Gene Name: YTH domain containing 1
  Uniprot ID: Q96MU7
  ENST ID: ENST00000613637
  CDS Start-End: 337-2466

SEQ ID NO: 200706 - DNA, 515 bp, Homo sapiens; identical to SEQ ID NO: 200701
  Payload ID: 19611
  Gene Name: YTH domain containing 1
  ENST ID: ENST00000625493
  CDS Start-End: 478-515

SEQ ID NO: 200707 - DNA, 689 bp, Homo sapiens; identical to SEQ ID NO: 200700
  Payload ID: 19611
  Gene Name: YTH domain containing 1
  ENST ID: ENST00000628264
  CDS Start-End: 1-281

SEQ ID NO: 200708 - DNA, 2983 bp, Homo sapiens; identical to SEQ ID NO: 200703
  Payload ID: 19611
  Gene Name: YTH domain containing 1
  ENST ID: ENST00000627168
  CDS Start-End: 1-2208

SEQ ID NO: 200709 - DNA, 265 bp, Homo sapiens; identical to SEQ ID NO: 200702
  Payload ID: 19611
  Gene Name: YTH domain containing 1
  ENST ID: ENST00000629100
  CDS Start-End: 154-265

SEQ ID NO: 200710 - DNA, 6316 bp, Homo sapiens
  Payload ID: 19612
  Gene Name: YTH domain containing 2
  Uniprot ID: Q9H6S0
  ENST ID: ENST00000161863
  CDS Start-End: 214-4506
attacgcccgcgctcctcgcctggccgtgatatcaatggcgcaggcttcacttctgctgtggcggtgactgaggcctttctggtgacctcagcccaacacaggccgtctccggagcttcccggtagtggccccggattcccacggtctttgtcattggctgtcagctagcaggcctggccgctcccgtgcggagagaccatctcttcagggcaatgtccaggccgagcagcgtctccccgcggcagccggctcctggcggtggcggaggcggcggcccctcgccttgtggccctgggggcggcggccgggccaaggggctgaaggacattcgcattgatgaggaggtgaagatcgcagtcaatatcgcgctggagcgcttccgatacggggaccagagagaaatggaatttccttcttctttgaccagtactgaaagagcctttattcatcgactcagtcagtctcttggtttggtctctaaaagtaaaggaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaaagaggagaatccgaatttgattcttttaggcagtctttaccagtgtttgagaaacaggaagaaattgttaaaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaagaagagaaacaacaaaccacacttacagaatggtactcagctcaagaaaatagtttcaagcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtgcagtactaatttttctgcctggatatgacgaaattgttggactgagagatcgcatcctgtttgatgacaagcggtttgctgacagtacacatagataccaagtctttatgcttcattcaaatatgcaaacatccgatcaaaagaaagtattaaaaaacccacctgcaggtgttcgaaaaataattctttccaccaatattgctgaaaccagcatcacagtcaatgatgttgtctttgttattgattctggtaaggtgaaagagaaatcctttgatgctctgaattttgttacaatgttaaaaatggtatggatttccaaagctagtgccatacagcggaaaggcagggcagggcgatgtagacctggaatttgttttcgtctgttcagtagactccgattccagaatatgttggaatttcagactccggaacttttgagaatgccattacaggaactttgcttacataccaagctgttagccccagttaattgtcccattgctgattttcttatgaaagctcctgaacctccaccagctttaattgtaagaaatgctgtacaaatgcttaagacaatagatgcaatggatacatgggaagatctgactgaacttgggtatcatttggctgacttgccagtagaaccacatcttggtaaaatggtcttgtgtgctgttgttttaaagtgtctggaccccatccttacaattgcttgcacactagcttatcgagatccttttgtactacctactcaggcctctcaaaaacgtgcagctatgctttgtaggaaacgttttactgcaggagctttcagtgaccatatggcacttctcagagcattccaggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatctgggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctctggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtgtgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccgctcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaa

SEQ ID NO: 200711 - DNA, 536 bp, Homo sapiens
  Payload ID: 19612
  Gene Name: YTH domain containing 2
  ENST ID: ENST00000514720
  CDS Start-End: 124-536
aacggcggcccaccgagtgatgggggtgcctccgaagagggagggaagacccgggccaccgtccggggcgggcctcagcggcggcacccgggtctggaacgcggctgttggccctgcggtggaatgcgagaaatggaatttccttcttctttgaccagtactgaaagagcctttattcatcgactcagtcagtctcttggtttggtctctaaaagtaaaggaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaaagaggagaatccgaatttgattcttttaggcagtctttaccagtgtttgagaa

SEQ ID NO: 200712 - DNA, 2629 bp, Homo sapiens
  Payload ID: 19612
  Gene Name: YTH domain containing 2
  ENST ID: ENST00000515883
  CDS Start-End: 188-2407
gtgatatcaatggcgcaggcttcacttctgctgtggcggtgactgaggcctttctggtgacctcagcccaacacaggccgtctccggagcttcccggtagtggccccggattcccacggtctttgtcattggctgtcagctagcaggcctggccgctcccgtgcggagagaccatctcttcagggcaatgtccaggccgagcagcgtctccccgcggcagccggctcctggcggtggcggaggcggcggcccctcgccttgtggccctgggggcggcggccgggccaaggggctgaaggacattcgcattgatgaggaggtgaagatcgcagtcaatatcgcgctggagcgcttccgatacggggaccagagagaaatggaatttccttcttctttgaccagtactgaaagagcctttattcatcgactcagtcagtctcttggtttggtctctaaaagtaaaggaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaaagaggagaatccgaatttgattcttttaggcagtctttaccagtgtttgagaaacaggaagaaattgttaaaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaagaagagaaacaacaaaccacacttacagaatggtactcagctcaagaaaatagtttcaagcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtgcagtactaatttttctgcctggatatgacgaaattgttggactgagagatcgcatcctgtttgatgacaagcggtttgctgacagtacacatagataccaagtctttatgcttcattcaaatatgcaaacatccgatcaaaagaaagtattaaaaaacccacctgcaggtgttcgaaaaataattctttccaccaatattgctgaaaccagcatcacagtcaatgatgttgtctttgttattgattctggtaaggtgaaagagaaatcctttgatgctctgaattttgttacaatgttaaaaatggtatggatttccaaagctagtgccatacagcggaaaggcaggtaatgtatatttaatgtatattcattcaattgcctgtaaaatggaaacgtttttatatgcattacacatttatcatatattccatgttcaataaaatagtagttttcatgttaaaatttttatattatttttgcaaagcaagccattttgatacttccttaaaagttgaatgtaggttatgttaaaattaaaaacttttgcctagttaaatgtacattcagatgt

SEQ ID NO: 200713 - DNA, 2138 bp, Homo sapiens
  Payload ID: 19612
  Gene Name: YTH domain containing 2
  ENST ID: ENST00000503857
  CDS Start-End: 203-499
gctcctcgcctggccgtgatatcaatggcgcaggcttcacttctgctgtggcggtgactgaggcctttctggtgacctcagcccaacacaggccgtctccggagcttcccggtagtggccccggattcccacggtctttgtcattggctgtcagctagcaggcctggccgctcccgtgcggagagaccatctcttcagggcaatgtccaggccgagcagcgtctccccgcggcagccggctcctggcggtggcggaggcggcggcccctcgccttgtggccctgggggcggcggccgggccaaggggctgaaggacattcgcattgatgaggaggtgaagatcgcagtcaatatcgcgctggagcgcttccgatacggggaccagagagaaatggaatttccttcttctttgaccagtactgaaagagcctttattcatcgactcagtcagtctcttggtttggtctctaaaagtaaaggattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaagaagagaaacaacaaaccacacttacagaatggtactcagctcaagaaaatagtttcaagcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtgcagtactaatttttctgcctggatatgacgaaattgttggactgagagatcgcatcctgtttgatgacaagcggtttgctgacagtacacatagataccaagtctttatgcttcattcaaatatgcaaacatccgatcaaaagaaagtattaaaaaacccacctgcaggtgttcgaaaaataattctttccaccaatattgctgaaaccagcatcacagtcaatgatgttgtctttgttattgattctggtaaggtgaaagagaaatcctttgatgctctgaattttgttacaatgttaaaaatggtatggatttccaaagctagtgccatacagcggaaaggcagggcagggcgatgtagacctggaatttgttttcgtctgttcagtagactccgattccagaatatgttggaatttcagactccggaacttttgagaatgccattacaggtaaaaattta

SEQ ID NO: 200714 - DNA, 747 bp, Homo sapiens
  Payload ID: 19613
  Gene Name: YTH N(6)-methyladenosine RNA binding protein 1
  ENST ID: ENST00000370334
  CDS Start-End: 248-406
ccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatattt

SEQ ID NO: 200715 - DNA, 3301 bp, Homo sapiens
  Payload ID: 19613
  Gene Name: YTH N(6)-methyladenosine RNA binding protein 1
  Uniprot ID: Q9BYJ9
  ENST ID: ENST00000370339
  CDS Start-End: 343-2022
cgcaggcgcgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 200716 - DNA, 2925 bp, Homo sapiens
  Payload ID: 19614
  Gene Name: YTH N(6)-methyladenosine RNA binding protein 2
  Uniprot ID: Q9Y5A9
  ENST ID: ENST00000373812
  CDS Start-End: 363-2102
ggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 200717 - DNA, 2719 bp, Homo sapiens
  Payload ID: 19614
  Gene Name: YTH N(6)-methyladenosine RNA binding protein 2
  Uniprot ID: Q9Y5A9
  ENST ID: ENST00000541996
  CDS Start-End: 307-1896
agagcgtcgccgagtcggagccggagcctgagccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 200718 - DNA, 2825 bp, Homo sapiens
  Payload ID: 19614
  Gene Name: YTH N(6)-methyladenosine RNA binding protein 2
  Uniprot ID: Q9Y5A9
  ENST ID: ENST00000542507
  CDS Start-End: 264-2003
agtctttccaggtgttagtcgaaacctcgtggtgcgaccctggtcgtcccaaaccccctaggccttaatcctggggcggtgggggcggggaggccgtgagcacggcttccgctcctccaatccgccagagggcgcagcggccggcctctcccttcccggggttcttcgcgccgggccccttccgcgtggacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatc

SEQ ID NO: 200719 - DNA, 864 bp, Homo sapiens
  Payload ID: 19614
  Gene Name: YTH N(6)-methyladenosine RNA binding protein 2
  ENST ID: ENST00000474884
  CDS Start-End: 264-864
agtctttccaggtgttagtcgaaacctcgtggtgcgaccctggtcgtcccaaaccccctaggccttaatcctggggcggtgggggcggggaggccgtgagcacggcttccgctcctccaatccgccagagggcgcagcggccggcctctcccttcccggggttcttcgcgccgggccccttccgcgtggacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaa

SEQ ID NO: 200720 - DNA, 879 bp, Homo sapiens
  Payload ID: 19614
  Gene Name: YTH N(6)-methyladenosine RNA binding protein 2
  ENST ID: ENST00000496288
  CDS Start-End: 157-879
gcctgagccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacagaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagc

SEQ ID NO: 200721 - DNA, 2067 bp, Homo sapiens
  Payload ID: 19614
  Gene Name: YTH N(6)-methyladenosine RNA binding protein 2
  ENST ID: ENST00000621244
  CDS Start-End: 151-1860
gccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaa

SEQ ID NO: 200722 - DNA, 5163 bp, Homo sapiens
  Payload ID: 19615
  Gene Name: YTH N(6)-methyladenosine RNA binding protein 3
  Uniprot ID: Q7Z739
  ENST ID: ENST00000539294
  CDS Start-End: 326-2083
aggaagagcgaggtgagcgcggacgtcagagtggagagcggaaggtcagggaggctcggagcggaagtgagactagggagtctgtccgccattgtggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactca

SEQ ID NO: 200723 - DNA, 3122 bp, Homo sapiens
  Payload ID: 19615
  Gene Name: YTH N(6)-methyladenosine RNA binding protein 3
  ENST ID: ENST00000517371
  CDS Start-End: 225-383
gagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtttcagtacaaaacggttcgattcatcaaaaagatgctgtaaatgatgatgattttgagccatacttaagtagccagacaaatcaggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaa

SEQ ID NO: 200724 - DNA, 420 bp, Homo sapiens
  Payload ID: 19615
  Gene Name: YTH N(6)-methyladenosine RNA binding protein 3
  ENST ID: ENST00000617952
  CDS Start-End: 162-420
gcggggcttcggctcctccccgtcgccgccgctgccggccccataacgagacctaaagggcaaggaaataaaggtggggaaacatgatgcacagatctgttgactttcctaacttgatgtagtcaggaccagagcaaagaatcacctggctcctaaggcccatgttctatcttgatttgactctgtttcatagagcagaggaaacaggcgaagaatcattttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagccta

SEQ ID NO: 200725 - DNA, 545 bp, Homo sapiens
  Payload ID: 19615
  Gene Name: YTH N(6)-methyladenosine RNA binding protein 3
  ENST ID: ENST00000619337
  CDS Start-End: 239-545
ataacggtgccccgggcgcaagttgctgcggtgtagctacccgggccggggcgtgcgccctggccccgtagcttgcgggcgggcgggcgcggtgccgcggcgggtggggagacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagca

SEQ ID NO: 200726 - DNA, 2370 bp, Homo sapiens
  Payload ID: 19615
  Gene Name: YTH N(6)-methyladenosine RNA binding protein 3
  ENST ID: ENST00000621413
  CDS Start-End: 355-2121
agagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaaggtggggaaacatgatgcacagatctgttgactttcctaacttgatgtagtcaggaccagagcaaagaatcacctggctcctaaggcccatgttctatcttgatttgactctgtttcatagagcagaggaaacaggcgaagaatcattttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgc

SEQ ID NO: 200727 - DNA, 2296 bp, Homo sapiens
  Payload ID: 19615
  Gene Name: YTH N(6)-methyladenosine RNA binding protein 3
  ENST ID: ENST00000621890
  CDS Start-End: 231-1835
ataacggtgccccgggcgcaagttgctgcggtgtagctacccgggccggggcgtgcgccctggccccgtagcttgcgggcgggcgggcgcggtgccgcggcggacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgcc

SEQ ID NO: 200728 - DNA, 593 bp, Homo sapiens
  Payload ID: 19615
  Gene Name: YTH N(6)-methyladenosine RNA binding protein 3
  ENST ID: ENST00000612880
  CDS Start-End: 259-593
tgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgg

SEQ ID NO: 200729 - DNA, 2363 bp, Homo sapiens
  Payload ID: 19615
  Gene Name: YTH N(6)-methyladenosine RNA binding protein 3
  ENST ID: ENST00000621820
  CDS Start-End: 198-1964
aagttgctgcggtgtagctacccgggccggggcgtgcgccctggccccgtagcttgcgggcgggcgggcgcggtgccgcggcggagacctaaagggcaaggaaataaaggtggggaaacatgatgcacagatctgttgactttcctaacttgatgtagtcaggaccagagcaaagaatcacctggctcctaaggcccatgttctatcttgatttgactctgtttcatagagcagaggaaacaggcgaagaatcattttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttg

SEQ ID NO: 200730 - DNA, 5076 bp, Homo sapiens
  Payload ID: 19615
  Gene Name: YTH N(6)-methyladenosine RNA binding protein 3
  ENST ID: ENST00000617200
  CDS Start-End: 393-1997
aggaagagcgaggtgagcgcggacgtcagagtggagagcggaaggtcagggaggctcggagcggaagtgagactagggagtctgtccgccattgtggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactc

SEQ ID NO: 200731 - DNA, 5092 bp, Homo sapiens
  Payload ID: 19615
  Gene Name: YTH N(6)-methyladenosine RNA binding protein 3
  ENST ID: ENST00000615676
  CDS Start-End: 224-349
agaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaaggagcagtaaagccagtgtcagaggagaacagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactca

SEQ ID NO: 200732 - DNA, 2387 bp, Homo sapiens
  Payload ID: 19615
  Gene Name: YTH N(6)-methyladenosine RNA binding protein 3
  ENST ID: ENST00000621957
  CDS Start-End: 227-1978
ccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttt

SEQ ID NO: 200733 - DNA, 563 bp, Homo sapiens
  Payload ID: 19615
  Gene Name: YTH N(6)-methyladenosine RNA binding protein 3
  ENST ID: ENST00000613853
  CDS Start-End: 206-563
gcaagttgctgcggtgtagctacccgggccggggcgtgcgccctggccccgtagcttgcgggcgggcgggcgcggtgccgcggcgggtggggagacctaaagggcaaggaaataaaggtggggaaacatgatgcacagatctgttgactttcctaacttgatgtagtcaggaccagagcaaagaatcacctggctcctaaggcccatgttctatcttgatttgactctgtttcatagagcagaggaaacaggcgaagaatcattttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctc

SEQ ID NO: 200734 - DNA, 5193 bp, Homo sapiens
  Payload ID: 19615
  Gene Name: YTH N(6)-methyladenosine RNA binding protein 3
  ENST ID: ENST00000623280
  CDS Start-End: 510-2114
aggaagagcgaggtgagcgcggacgtcagagtggagagcggaaggtcagggaggctcggagcggaagtgagactagggagtctgtccgccattgtggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaaggagcagtaaagccagtgtcagaggagaacagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactc

SEQ ID NO: 200735 - DNA, 4156 bp, Homo sapiens
  Payload ID: 19616
  Gene Name: YY1 associated factor 2
  Uniprot ID: Q8IY57
  ENST ID: ENST00000327791
  CDS Start-End: 57-671
attgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgatccacattgtttgaagttattgtgagtgcctcgaggaccaaggaaccgttgaaatttccaatttcaggaaggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctggtgggtgtgcactatgagattggagaaatgaattaagttgacttgaaattattttacttttattaatcacaggtatctcaacctgcctttgtttcaccctacttcaagtacacttccacaccaggaaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaa

SEQ ID NO: 200736 - DNA, 1211 bp, Homo sapiens
  Payload ID: 19616
  Gene Name: YY1 associated factor 2
  Uniprot ID: Q8IY57
  ENST ID: ENST00000380790
  CDS Start-End: 108-524
ccctccctccctcctcccccgcccgcttccgcccggcttattatcctccttattgacaaacagagcggtcgcggcggcgactctcggcgtgcggtgatagccaagccatgggagacaagaagagccccaccaggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaat

SEQ ID NO: 200737 - DNA, 2076 bp, Homo sapiens
  Payload ID: 19616
  Gene Name: YY1 associated factor 2
  Uniprot ID: Q8IY57
  ENST ID: ENST00000534854
  CDS Start-End: 69-611
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcaca

SEQ ID NO: 200738 - DNA, 434 bp, Homo sapiens
  Payload ID: 19616
  Gene Name: YY1 associated factor 2
  ENST ID: ENST00000548661
  CDS Start-End: 124-258
tgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtctcccagttggttgcacagcaggttactcagcagtttgtgcctcctacacagtcaaagaaagagaaaaaagataaagtagaaaaagaaaaaagtgaaa

SEQ ID NO: 200739 - DNA, 269 bp, Homo sapiens
  Payload ID: 19616
  Gene Name: YY1 associated factor 2
  ENST ID: ENST00000548917
  CDS Start-End: 168-269
cggccgcggggcccgggcaccgggcgcggcctgctggtgaccccgcgccgcgtcgtgtccgggttgtgtcctgcaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacag

SEQ ID NO: 200740 - DNA, 580 bp, Homo sapiens
  Payload ID: 19616
  Gene Name: YY1 associated factor 2
  ENST ID: ENST00000546726
  CDS Start-End: 1-204
atgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgagaagaaaaagctggatcacttaccagtaactggagttctcctattgggtaatctccacagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactgagataacaggaagagagcctggttaccatttggtggaacaatcctgctggctcaagcctctgcctagaaatttgggtcattctcttttttggacagtctggaaacctcgacctgtctcccagttggttgcacagcaggttactcagcagtttgtgcctcctacacagtcaaagaaagagaaaaaagataaagtag

SEQ ID NO: 200741 - DNA, 702 bp, Homo sapiens
  Payload ID: 19616
  Gene Name: YY1 associated factor 2
  ENST ID: ENST00000551268
  CDS Start-End: 84-254
gcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgtacatctaagctcttgtagatccaatttttagtggtggaaacattacttgaggaggactcagagaagcattgtcatttggattgaaactgaagaggctctgggcaactcaccagaaatctaagggacactgtgttcctgaaaatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccag

SEQ ID NO: 200742 - DNA, 571 bp, Homo sapiens
  Payload ID: 19616
  Gene Name: YY1 associated factor 2
  ENST ID: ENST00000547254
  CDS Start-End: 170-373
agctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgagaagaaaaagctggatcacttaccagtaactggagttctcctattgggtaatctccacagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtct

SEQ ID NO: 200743 - DNA, 1034 bp, Homo sapiens
  Payload ID: 19616
  Gene Name: YY1 associated factor 2
  ENST ID: ENST00000552109
  CDS Start-End: 69-287
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgagataacaggaagagagcctggttaccatttggtggaacaatcctgctggctcaagcctctgcctagaaatttgggtcattctcttttttggacagtctggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactatt

SEQ ID NO: 200744 - DNA, 545 bp, Homo sapiens
  Payload ID: 19616
  Gene Name: YY1 associated factor 2
  ENST ID: ENST00000552928
  CDS Start-End: 44-406
gcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgaatgaagaatcatgaaatcataagtttcttgaaggaaggagagaagaaaaagctggatcacttaccagtaactggagttctcctattgggtaatctccacagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtctcccagttggttgcacagcaggttactcagcagtttgtgcctcctacacagtcaaagaaa

SEQ ID NO: 200745 - DNA, 807 bp, Homo sapiens
  Payload ID: 19616
  Gene Name: YY1 associated factor 2
  ENST ID: ENST00000547351
  CDS Start-End: 42-332
ggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgatccacattgtttgaagttattgtgagtgcctcgaggaccaaggaaccgttgaaatttccaatttcaggaagagataacaggaagagagcctggttaccatttggtggaacaatcctgctggctcaagcctctgcctagaaatttgggtcattctcttttttggacagtctgcttctaaattactttaattgaagagcttcccaagattcaaggtgaatttaaagttaaaagattgtcatttgaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcatt

SEQ ID NO: 200746 - DNA, 5095 bp, Homo sapiens
  Payload ID: 19616
  Gene Name: YY1 associated factor 2
  Uniprot ID: Q8IY57
  ENST ID: ENST00000555248
  CDS Start-End: 170-523
agctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgggacagcaaggaaggggggaagctggtgtcctactccacagccagtcttggggttagaggaaccctgagaaatagagtaggtggtggcagctcagaagagaagaaacaggctgaatacctggcacctggaagaagaaggaatatagtacacaggggagttggcccaggacagagaagtgggcctagtttaaaagaggcttgaggcccacatgggggcccctgacattttttttttttaccagtacatctaagctcttgtagatccaatttttagtggtggaaacattacttgaggaggactcagagaagcattgtcatttggattgaaactgaagaggctctgggcaactcaccagaaatctaagggacactgtgttcctgaaagtaagtgttctacaccacgaccctctcagcttcttccttcctctctctgaattctcttctcttttgattttggctctaagttaaacctaagagctctaatttctctgttatctgttattttcctagtggtttctgaaattcagggtagaatctgtgtttgtatagaacagtgtggaacagggtattgttactagagaagatattgattgcatcacagaatattaatatttttcctctctggtaatgttaaaaaaacaagattaaaggactgcagaacggtgttgagaagcaaaagtttcagtagttggaagaaataattctccataattgacttattaatgaacagggtaatttccagagtaaggttggcaagtactaaagccaagactggatagctgcagagcagaaggatgcagtttgctaatgatttgtttgtgtgacgcacagatgggatttgaatcctttgggtcagactgacctttgaactgattctgcctcattgccaaatgttaggccaagtctaagccattctagacatttgaaaaacttttttctttttagacctgcagagaagattgagtccttgttctacctttgaagtcttctttttttcttttttcttttttgagataagatctcattctgttgcccaggctgggttgcagtggcatcatccaggctcactgcagcctcgaactcccaggttcaaggaatcctcccacctcagcctcccaagtagctgaaactacagatgcacaccaccatgtgtggctaattttcttattttttgtagagatgggggatctctatgttgcctaggctagtctcaaactcttgagctcaagtgatcctcctaccttggcctcccaaagaactgggattataggaatgagccaccattcggcccctttaaagtctttattggcaatataattttttttctttaaataatattaagttcaaattctttatgcaacagaagcccatttcctttggctatatccatggtaggtcatgtctttctagagaacgaagttacattcatggcatgtatttcaaaataaaatgatttgttgtagcttcagttcctcaagttttaattttattttagattttggggtacatgtgcatgtttgttacttgggtatattgcagagtggtgggattgggattccagtgtacccattacccaaatggtgaacgttatacccaacaggtcatttttcagcccctcactccaaaattttttacattgtgcttttgtgagagaaacagtagtaaatgtcaaactgacaggaaattttttaaaaggaaacaaaatgccacggtgacacattattttcaagatgctgcacagtctttatatctgaagtttcttttctttcttttcttttcttttcttttcttttcttttcttttctctttttttttttgaggcagaatttgagacagtcttgctctgtcgcccaggctggagtacagtggcgtgacctcggctcactgcaacctccacctcccaggttcaagcaattctcatgcctcagcctctgtggtagctgggattacaggtgcccgccaccacaccaggctaatttttgtatttttagtagagatggggtttcactatgctggccaggctggtctcaaactcctgacctcaggtgatccgtctgcgtcggcttcccaaagtgctgggattacaggagtgagacactgtgcccagcctatctgaagattcttataaggcaagaaatgtcccaaatataaatgcaagaaactttaggaaattaaggatcattcttggctggcccagtggcccacacctgtaagcccagcaccttgggaggctgagacaggaggatttcttgaggccaggagtttgagaccaacctgggcaacacagtgagatctcgtctctactaaaaattaaaaaaattagctgggtgtggtggtgcatgcctgtggtcccagctactcaggaggctgaagtgggaggatcccttgagccccagagttcgaggttgcagtgagctgtgatcataccactgcactccagcctgggcaacagagtgagaccttgtctcaaaaaaacaaaattctgagtcatcagagaaaatgaaatattaaatattaaggatagtctgtatgagggtgataatcaatgtgtgatgattaatttaagactggtgtcttattggtacttcatctagtagtggacagttacttaatattgcttaattcagatagcaaatatttagaaatgaaaatgatagaattattggtttgggtttcaaactgtggtctaaatggttcataccaggctttcaaatgtaacaggtaatgttacattttgttagaggatattataacagtcctttaggtttctcataggtgttattttagagagctataaaaaagatttcacatagtagaaagagtgctagatgttacactagtatgattttggtaacctgggttcatatctcatttcatatcaaccatttcaatattcagcattcagcaaatgtttattgagcatcttatttaagggctgagttggatactagacatacagtggtgagcaaaatggatttttttgtttctttaaaattttacagttttgcaaattagaaccgctttaactgtaccaagctctatatgtgaggtttagtgttagtagatctttcctttatgtgtaggctgaagaggtggaacttcttcattaaaaatatatgttgtttataactgaacacagtattattattatggttaggtaaaaagagtgagttatttcagcttcttttaaaagtaagctataaaatccacattctgaaagaagcttaaaccaactatcatctggtagaaatcttttcagcatcgttgttttcttgtcatacttgctttatgtcttcaaatttgaggtttggcactgattcttctagacttttggtgtaggaatgggagaaaaaaattgaggaccatctacataagtcctttttaaagaaatgcatggttcctgagccgcctcctgtctatctgaggagcctttctagcaaccatttagttgttcagagactccttattctaggagatttcttacttgtttgttttttgtcctgtaagaggactcacactggttaattgtatatgggtaaattttacaagtgattattagtgtttgtgtagtctggatatcagagtggttttcaaagtgtagtctgagggacactgagagtccctgagatctttttagttgaagctttctatgaggttcacactgtttttataataatttgaagatgttatttgcctttttcactgtgatggtgcagaggcagtgatgggtaaaactgccagcaccttagcatgaatcaaagcagtggcaccaaattgctatcttcattgtaatattcaccaccatgtacatgcatgcagtaagaataatgtcagtttgaattaagaatatccttgaagcagaaaaatttactaattttattacatctcatatttttaaaaatattctgtctgaccaaatgggaactacacataaagcacttctactgtataccaaagtacagtggttaagggaaagcacatgtgtagtttgtcttgcaagcagagctagtctttttgtcatagagcatcatttttacttgaaagactacctgaaataccatagttattcagacttggatatttagcatatattttcttgaaaatgaatatattcaaaaaatatatcacttcaaggaaaacacttgatactatatgttgccagtgataatcattcaagtgaaaattagaatttttgaaaatttgtagcaacaatgagctttagagtttctgtgtataaagacttttctgagaagattagtggtggtatcaatgaatataatttctgatatttcaccatgaaatgtgtcagcatttggaagctacgcataactcagcaaacaaatggttcctagttaccgatgtatgattttacaaaactgtaatgggtaatccatcaaagtacaaaataccaacagattttaagggaacactgaaaacttcattgatgtggtttcagatttcatattgcaactaacctttgagaaacaactgtgtttttatgtagtatcaaagaataacacctatagttatctgaaaatgctattcaactacttacctcttttcaactgtatatctgtgagagtccagattttcttaatatttttggaccaaaacaacatattgcaacaaattgaatgctgagatagatgtgacaatccaggtgtcttctactaaccagatgttagaggtttgcaaaaatatacgatgccactcttcatacaaaatatctttgttttggaaaataataagtttttaaaataaaaatatgtcattt

SEQ ID NO: 200747 - DNA, 2626 bp, Homo sapiens
  Payload ID: 19617
  Gene Name: YY1 associated protein 1
  Uniprot ID: Q9H869
  ENST ID: ENST00000295566
  CDS Start-End: 25-2415
cctcgatcccctcgccgcggtcccatggaggaggaggcgagccgcagcgccgcggcgacgaacccagggagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200748 - DNA, 2682 bp, Homo sapiens
  Payload ID: 19617
  Gene Name: YY1 associated protein 1
  Uniprot ID: Q9H869
  ENST ID: ENST00000311573
  CDS Start-End: 312-2471
aacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactgtgagtaatgatcctcaagtgagaacatgggattttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200749 - DNA, 2524 bp, Homo sapiens
  Payload ID: 19617
  Gene Name: YY1 associated protein 1
  Uniprot ID: Q9H869
  ENST ID: ENST00000347088
  CDS Start-End: 61-2313
gaagaggaggtggagaaggcttgggctcgcgccgctgaagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200750 - DNA, 2498 bp, Homo sapiens
  Payload ID: 19617
  Gene Name: YY1 associated protein 1
  ENST ID: ENST00000354691
  CDS Start-End: 180-770
gagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgtttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200751 - DNA, 2663 bp, Homo sapiens
  Payload ID: 19617
  Gene Name: YY1 associated protein 1
  Uniprot ID: Q9H869
  ENST ID: ENST00000355499
  CDS Start-End: 200-2452
ggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200752 - DNA, 2690 bp, Homo sapiens
  Payload ID: 19617
  Gene Name: YY1 associated protein 1
  Uniprot ID: Q9H869
  ENST ID: ENST00000359205
  CDS Start-End: 260-2479
gtagggtgggggtgctggcggcggctgctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200753 - DNA, 2701 bp, Homo sapiens
  Payload ID: 19617
  Gene Name: YY1 associated protein 1
  ENST ID: ENST00000361140
  CDS Start-End: 242-739
gctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200754 - DNA, 2743 bp, Homo sapiens
  Payload ID: 19617
  Gene Name: YY1 associated protein 1
  Uniprot ID: Q9H869
  ENST ID: ENST00000361831
  CDS Start-End: 313-2532
gaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200755 - DNA, 2555 bp, Homo sapiens
  Payload ID: 19617
  Gene Name: YY1 associated protein 1
  Uniprot ID: Q9H869
  ENST ID: ENST00000368330
  CDS Start-End: 92-2344
cctcgatcccctcgccgcggtcccatggaggaggaggcgagccgcagcgccgcggcgacgaacccagggagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200756 - DNA, 3073 bp, Homo sapiens
  Payload ID: 19617
  Gene Name: YY1 associated protein 1
  Uniprot ID: Q9H869
  ENST ID: ENST00000368339
  CDS Start-End: 193-2859
acgcgtgagggcctgcgctggagccggcttgacagggtctgagggggagtggagaactgggcgaggaggttcccgtgggtgagcgcgtacgggatggctggctcgcaggacggccgaaggtggtggttggtgggagcagccagcgacgagcccgtagacactcgtacgcgtgcgggctgacgtgcgcgctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttcattg

SEQ ID NO: 200757 - DNA, 2927 bp, Homo sapiens
  Payload ID: 19617
  Gene Name: YY1 associated protein 1
  Uniprot ID: Q9H869
  ENST ID: ENST00000368340
  CDS Start-End: 110-2716
cgcgtacgggatggctggctcgcaggacggccgaaggtggtggttggtgggagcagccagcgacgagcccgtagacactcgtacgcgtgcgggctgacgtgcgcgctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200758 - DNA, 2011 bp, Homo sapiens
  Payload ID: 19617
  Gene Name: YY1 associated protein 1
  ENST ID: ENST00000405763
  CDS Start-End: 12-1499
gtgcgcgctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggtacagccctcttcctcgaagtctgtaggaggcagaaggtcactgaaagttctgagagaatatcaaggacttccttaatcgtctaatgctttagttgtagaactaggacttcaggaatcttcctgattcacctttcttcccttacttttctgcccttctccgggtgattctacaacattttcaaaataatgggtaaaatggtaatttgctaaaggaaattcagagaagagtttctaaagtgtataattggactgtggtctttgtagaaatttcatatgcagagtcccttggaaagatgccttgagcttgtctcaggtccctaaacttagaaagtcctattctttttcccaaattctgacatgtgctggatcagagtgttctcatttccaataggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccg

SEQ ID NO: 200759 - DNA, 2654 bp, Homo sapiens
  Payload ID: 19617
  Gene Name: YY1 associated protein 1
  Uniprot ID: Q9H869
  ENST ID: ENST00000404643
  CDS Start-End: 251-2443
gcggcggctgctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200760 - DNA, 2705 bp, Homo sapiens
  Payload ID: 19617
  Gene Name: YY1 associated protein 1
  Uniprot ID: Q9H869
  ENST ID: ENST00000407221
  CDS Start-End: 335-2494
gtagggtgggggtgctggcggcggctgctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactgtgagtaatgatcctcaagtgagaacatgggattttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200761 - DNA, 2684 bp, Homo sapiens
  Payload ID: 19617
  Gene Name: YY1 associated protein 1
  ENST ID: ENST00000436865
  CDS Start-End: 65-211
gaggaggaggcgagccgcagcgccgcggcgacgaacccagggagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacgccagcttctgttactgatgtaaggatgcagagtcctgtcaggagttaggtgtcaagtgaagtctccttgttatggggcagtgcagctgtaggccaagctgtatctgtttgggaagggagaaaaaacagtagctggcatccatatccacttctccgggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 200762 - DNA, 932 bp, Homo sapiens
  Payload ID: 19617
  Gene Name: YY1 associated protein 1
  ENST ID: ENST00000443231
  CDS Start-End: 315-932
cgccgctgaaggtacgcgtgagggcctgcgctggagccggcttgacaggtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtat

SEQ ID NO: 200763 - DNA, 810 bp, Homo sapiens
  Payload ID: 19617
  Gene Name: YY1 associated protein 1
  ENST ID: ENST00000454523
  CDS Start-End: 228-810
gcgtgagggcctgcgctggagccggcttgacagggtctgagggggagtggagaactgggcgaggaggttcccgtggtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactg

SEQ ID NO: 200764 - DNA, 6697 bp, Homo sapiens
  Payload ID: 19618
  Gene Name: YY1 transcription factor
  Uniprot ID: P25490
  ENST ID: ENST00000262238
  CDS Start-End: 261-1505
cgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgtcccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctcccaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctgacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacacccagatgctgtaaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattatgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttttaa

SEQ ID NO: 200765 - DNA, 636 bp, Homo sapiens
  Payload ID: 19618
  Gene Name: YY1 transcription factor
  ENST ID: ENST00000554371
  CDS Start-End: 535-636
ttctcgtcaaagcagactttattggggcgacagggccgccccgcacgcgccagccgctccccgcgcggcccccgggccgcccacccgcctcaaccccgctcccggccggcccctccctcccttctcctcaggctcccgcccccgtggtgcccggggccgcgcggaccgctcaccggctcccaaggcagcggctgtagcggcgacgccccgttcccgagtgcggccccggcccgaggcggcgggttttgtggctgttgcaccgcgaagggcggcagccgcgcgacaccgggaagcgggaggcggtggcggcggcggcggcgcgctgacgtcacgcgccgcgggccagccagggcgcgtgcgagccgccccgcccccggtcccatcggccccaatccgggaggagcccggcgagtgggcggggccgcggaggccagcggacagatcgattggccgagaggagaatcgagagggcgaacgggcgagtggcagcgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggag

SEQ ID NO: 200766 - DNA, 422 bp, Homo sapiens
  Payload ID: 19618
  Gene Name: YY1 transcription factor
  ENST ID: ENST00000553625
  CDS Start-End: 1-370
ccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagggctgcacaaagatgttcagggataactcggccatgagaaaacatctgcacacccacggtcccagagtccacgtctgtgcagaatgtgg

SEQ ID NO: 200767 - DNA, 1114 bp, Homo sapiens
  Payload ID: 19618
  Gene Name: YY1 transcription factor
  ENST ID: ENST00000554804
  CDS Start-End: 1-572
tcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaatgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaa

SEQ ID NO: 200768 - DNA, 2741 bp, Homo sapiens
  Payload ID: 19619
  Gene Name: YY2 transcription factor
  Uniprot ID: O15391
  ENST ID: ENST00000429584
  CDS Start-End: 499-1617
attaaataagagaaaaaagcataaaaggagtaggcttttttggcagatactgttatatgggatggacaggaggggaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctttcctcagtctcgcgcctttctctgcagctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttcccacggtcttcccgttgccgctaacctaactaactctcagccatggcctccaacgaagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattgatctctcagatcctaaacagctggcagaatttactaaagtgaagcccaaaaggtccaaaggagaacctcccaaaacagtcccttgctcttatagcggctgcgaaaagatgttccgggattacgccgccatgagaaaacatctccacatccacgggcccagagtccacgtatgtgcagaatgtggcaaagcttttcttgagagctcaaagctgagacgacaccagctggtccacaccggcgagaagccctttcagtgcacattcgaaggctgcgggaaacgcttttcccttgatttcaatttgcgcacacacttgcgcatccacaccggcgataagcccttcgtgtgccccttcgatgtttgcaacaggaagttcgctcagtcaaccaacctgaaaacccacatattaacgcatgtgaagaccaaaaacaacccgtgaaaaggagaagacccctctcagacttgggaattatcttccaggactgcggtagggaataaatatgcctctcaaagctttgtatgttgtttctaagagttttaaaaaaaaatgaatcctgcacatttaaggttcgtgttttgttagagtagtaaaaatagaatttaaacgtttttaaaaaggtaaaccttgacataagataatagtgctaagatgccatagcttgttctgtaactatttttgtaaagtttggtcccaacaggagaaaaattcgtagacttcacatcaagagacggttcttacaaactgtttaaaatgggacttttcacattcttagaaataggaagttcatttattgtttacaatgtttttaaaaaacttgttaaaaaattcaaagtgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtagtcttggatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaggaaaaaagtagtttgcctatatcagtacagaagttagaactaaagaaaagggggagggtgctactggcatctggtgagtggagggagatcaggaatgccactaaacatcctacaatgcacagacagccccacgaaacacataattatttggctaaaatgccaatagtgtcaggtgcaggggctcaggcctgtaatgtcaacactttgggaggccgaggtgggtggatcgtttgagctcaggaattgaacatcagcctgggcaacatggcataactcggtctctacc

SEQ ID NO: 200769 - DNA, 2933 bp, Homo sapiens
  Payload ID: 19620
  Gene Name: ZBED6 C-terminal like
  Uniprot ID: Q96FA7
  ENST ID: ENST00000343855
  CDS Start-End: 617-1327
aggctcctgagtgatttcccccagctgccctcgtttgcatttggatagagcttggttggagttccaagggctgatgctgggaaccttgctctggatgcgaggcctgcccctggagggagccgcggaggactggcagctgcagatgctggagcaggccagcctgtggctgggccgtagcttcctgctggcaggcttcctggtatcgagcagctgccccagcctggagcaggcggccaagggtgagggctgttcccccatcccttgtttcgcccactgcctcgactccctggtgagaaactttctgtgtcaccctcacagtgtccagatcatcctgggcactgccagggccacctgcagccatttctaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcaccagctggggaaggctggtgttgccttgtcggccacattctggagcccggcagacagcctcagcaagctcctgtagcccttccagatggtggtccgcgaggcgagtgcggcacaggcctctctgagccaggtgctgccccagctgcgctacctgcacatcttcctggagcaggttcacacacactttcaggagcagagtgtcggggagaggggcgcagccatccagctggctgaggggttggcccggcagctctgcaccgactgtcagctcaacaagctcttctaccgcgaggagtttgtgctggccaccttgctggacccttgcttcaaggggaagattgaggccatcctgccatgggggccgaccgacattgaccactggaagcaagtcctcgtgtacaaggtgaaggagattagagtgtctgaatactctttgaactccccaagtcccctgcaaagccccaggggtctgtgcgtggaccccaccagggtagccaagagctccggggtggaggggagaagccagggggagcctctgcagagcagcagccactctggggccttcctgctggcccagagggagaagggcttgctggagagcatggggctgctggcctctgagagaagcgggggctcgctgtccaccaagagccactgggccagcatcattgtcaagaagtatctgtgggagaatgagaccgttggagcccaggatgaccccctggcttactgggagaagaagcgagaagcctggccaccatctatctgtcttaccccccacaggagccttctctgaaagcatctttgcctccctgaacagccccacccttgtagagcaaaactcttctctcaaggtggaagccattgagcatctcctcttcttgaaggccaacctggagcagttccccaactacaccccgcctcccctcatctgctctagtggtgacctggccaaggggatacagaccctgcagtccgctcagggtgggatggcagacatggcaggtgccggtgctcaccctgcccgtgaactcctagagagcccctgcctgtaataggtcaaagcagagagctgggtgttgcatcctgggcgccacatgctcatggccagaatcttaaacctatttggtaggaaagggtcagtttctcacttgacagattgccatatttttttttctgggagatgtcattttccatctcccgattacttcctttacgtctagcagtatgtgccgagaagaggcttactctcttcgtaggtgactgtgaattttgtactacgtggctttgtacatgtgatgctctgttaaaacataagtgggtatgaaggtccttgcatacaccttgtctgtgtggataagtggacacatgcccttaagaggcttgctttctcaaaaagtggccaaggatgtggagtgggcatgtgctggcaggtgggatatgtcctcagcctttgggggcctggataagctattgcagcactttctgaggctttcactgtagggagaaggaaaccccaagggtagaatagccatttccagagggaagtacacacatacccccacacaccagtctttttgggggtttcagagtggccggagaaaccgactgaagggactgaccagctagctaggagagctgagacgccagtcctcaaatggcgttcttaccaatagtctatttccagactactggaaacgttggggtttcttcctccagtgacagcagcctcagtagctttcctgggctccaggcggctggctgcacaccctgcctgccatcacccttgcccctgcttgtcctggaccacttttaaaggggaagtcccttatttggaagagagaaaggatgtgtgtagcacacactcatcatggattgctcagagttcctttagggcagagctgagggcctgggatccaggaaccagtgggattggatgggagaagaaggaagggggtggcccgtcacccccgcaagacttgcatccaggtagcctaaggactcctggtcactgggtagggtggctgctgagatgcaggtcggaagaggcaggggaaggctccaggcctaacttggagcatgtcactggccatgggggtgaggggacagactctgctctcactggctggcagccccaggagcctgttcccttgcctctcctggatgggttgtcagccctgtgtttcactgtgaccaattcattataacatttggatattactgaaaatgtaaggaagcaggaaaaattaactactttcattcagagatagcctctatcaatagtttgacatttttccctcttttacattgagatcataccctaggtactgtttagtatgcaatattttcattttcgcagtataataattgcacctgttaaataaagttttgtaaacatttaa

SEQ ID NO: 200770 - DNA, 2195 bp, Homo sapiens
  Payload ID: 19621
  Gene Name: Z-DNA binding protein 1
  Uniprot ID: Q9H171
  ENST ID: ENST00000371173
  CDS Start-End: 179-1468
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccaaccataa

SEQ ID NO: 200771 - DNA, 2073 bp, Homo sapiens
  Payload ID: 19621
  Gene Name: Z-DNA binding protein 1
  Uniprot ID: Q9H171
  ENST ID: ENST00000395822
  CDS Start-End: 282-1346
tttttttttctttcaaaagacgaacagagaagtttcattttctttttctcctgaaaccgaatctggccggcctggctaggcatctatttccgggctgtaagcagctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaagccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccaaccataa

SEQ ID NO: 200772 - DNA, 357 bp, Homo sapiens
  Payload ID: 19621
  Gene Name: Z-DNA binding protein 1
  ENST ID: ENST00000453793
  CDS Start-End: 1-357
cgtgctttctcgaggacgccaccatcggcaacagcaacaaaatgtctatcagcccaggggtggctggcccaggaggagtcgcagggtctggagagggggagccaggggaggacgcagttgctgccttcactgaagtcttgaacccctcaaagtcattcatgaaatttggaatcaacttcttccagactcctgtgaatgttgatagtttgacctcctcccatgaatcacaaatgttcttaacggcatgtagattggtgatcttttccagaagattttcaacttactttgcccagatccatctgaggaatcactctgtgttgcacttatgccctcataaaatatatttattgaagaata

SEQ ID NO: 200773 - DNA, 1041 bp, Homo sapiens
  Payload ID: 19621
  Gene Name: Z-DNA binding protein 1
  Uniprot ID: Q9H171
  ENST ID: ENST00000541799
  CDS Start-End: 100-846
cagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggtaagtcacccaagagagcccagggaggggacctcggtggggagccaccggatcctctgggtgggggcaaagggtagggatggggagtggggggattctgccctccaaggggaaagggttgcttccagacccccacagtccacctttacggccgtcctgagaatgaggacacctggatcaaagctctcctgatttccctgtactctgatactttctacctcattttaaagtttaatttaatttttatttttctaataaaattttaaaattaa

SEQ ID NO: 200774 - DNA, 2437 bp, Homo sapiens
  Payload ID: 19622
  Gene Name: zeta-chain (TCR) associated protein kinase 70kDa
  Uniprot ID: P43403
  ENST ID: ENST00000264972
  CDS Start-End: 216-2075
atccaggaaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 200775 - DNA, 1085 bp, Homo sapiens
  Payload ID: 19622
  Gene Name: zeta-chain (TCR) associated protein kinase 70kDa
  Uniprot ID: P43403
  ENST ID: ENST00000451498
  CDS Start-End: 147-1085
tgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctga

SEQ ID NO: 200776 - DNA, 1502 bp, Homo sapiens
  Payload ID: 19623
  Gene Name: ZFP1 zinc finger protein
  ENST ID: ENST00000332307
  CDS Start-End: 195-1319
caccaccagcggcgagtgggtgacagagcccccgtctccgcgcgtcttcgccgccctgcgccgtgacccgctgtggcactgggccacgagtggaggctgcgcccctccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagct

SEQ ID NO: 200777 - DNA, 3250 bp, Homo sapiens
  Payload ID: 19623
  Gene Name: ZFP1 zinc finger protein
  Uniprot ID: Q6P2D0
  ENST ID: ENST00000393430
  CDS Start-End: 125-1348
cgccgccctgcgccgtgacccgctgtggcactgggccacgagtggaggctgcgcccctccaggtacgagaggggcttccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaacccttatata

SEQ ID NO: 200778 - DNA, 1426 bp, Homo sapiens
  Payload ID: 19623
  Gene Name: ZFP1 zinc finger protein
  ENST ID: ENST00000568079
  CDS Start-End: 194-280
atgtgcagtgctgcgagcgcgccggtggccgcccttcccccaccaccagcggcgagtgggtgacagagcccccgtctccgcgcgtcttcgccgccctgcgccgtgacccgctgtggcactgggccacgagtggaggctgcgcccctccagttctgccttcatagttctctgcctttgcccaaaactgcagaaaatgaacaaatcccagaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaata

SEQ ID NO: 200779 - DNA, 493 bp, Homo sapiens
  Payload ID: 19623
  Gene Name: ZFP1 zinc finger protein
  ENST ID: ENST00000567481
  CDS Start-End: 261-491
ctcgtgggtggaggaaggactggagcctggtcagttgccggtggtgaaggagaaccgtgatccctttgtcagagggtcttcagtgaggtgttcccctgatcctcgcatccaccccgtgacttccagcgttatcatctccgtcgctatcccaggaacacgggaggttcagaaggggaaagtgatttccctaaggtctcacaacccggtggtactttatttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtgggtaaggacggttttcagaagtgtggaaggctgatgaccagatggagagagaccacagaaacccagacgagcaggcgaggcaatttttaatt

SEQ ID NO: 200780 - DNA, 1457 bp, Homo sapiens
  Payload ID: 19623
  Gene Name: ZFP1 zinc finger protein
  Uniprot ID: Q6P2D0
  ENST ID: ENST00000570010
  CDS Start-End: 196-1419
gcatgtgcagtgctgcgagcgcgccggtggccgcccttcccccaccaccagcggcgagtgggtgacagagcccccgtctccgcgcgtcttcgccgccctgcgccgtgacccgctgtggcactgggccacgagtggaggctgcgcccctccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccag

SEQ ID NO: 200781 - DNA, 3067 bp, Homo sapiens
  Payload ID: 19623
  Gene Name: ZFP1 zinc finger protein
  ENST ID: ENST00000464850
  CDS Start-End: 161-391
cttcccccaccaccagcggcgagtgggtgacagagcccccgtctccgcgcgtcttcgccgccctgcgccgtgacccgctgtggcactgggccacgagtggaggctgcgcccctccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtgggtaaggacggttttcagaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatg

SEQ ID NO: 200782 - DNA, 7489 bp, Homo sapiens
  Payload ID: 19624
  Gene Name: ZFP14 zinc finger protein
  Uniprot ID: Q9HCL3
  ENST ID: ENST00000270001
  CDS Start-End: 117-1718
ttctttccggcttcgctgctggtgtcggctccgagagctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactaggaccttccatttctaaaccagatgtgattaccttattggatgaagaaaggaaggaacctgggatggttgtgagggaagggacaagaagatactgccctgatttggagtccagatacaggaccaatactttatctccagaaaaggacatttatgaaatatattcatttcagtgggatataatggaaagaattaaaagctatagccttcagggttccatttttaggaatgattgggaatgcaaaagcaagattgagggggaaaaggaacaacaagagggatattttgggcaagtgaaaattacctctgaaaaaatgaccacttacaaaaggcacaattttcttactgagtatcagatcgttcataatggagaaaaggtgtatgagtgtaaggagtgtaggaagacctttattcgtcgctcaacacttagtcaacacctgagaattcatactggtgagaaaccttataagtgtaaggaatgtgggcaggcctttagacagcgtgcacatcttattcgacatcacaaacttcacaccggtgagaaaccctatgaatgtaaggagtgtgggaaggcctttacagtgctccaagaacttactcaacatcagagacttcatacgggtgaaaaaccctatgaatgtaaggaatgtggaaaggcctttagagtacatcagcaactggctcgacatcagagaattcacactggtgagaaaccctatgaatgtaaggactgtggaaagacctttagacagtgtacacaccttacacgccatcagagacttcatactgctgaaaagctctatgaatgtaaggaatgtgggaaagccttcgtatgtggtccagaccttagagtacatcagaaaattcattttggtgagaaaccctatgaatgtaaggagtgtggaaaggcttttagaatatgccaacaacttactgttcatcagagtattcatactggtgagaaaccctacgaatgtaaggaatgtgggaagacttttagattaagacaacaactagttcgccatcagagaatacatactcgtgagaaaccctatgaatgtatggaatgttggaagacctttagtagttactcacagcttatttcacaccagagcattcatattggtgagagaccctatgaatgtgaagagtgtggaaaggcctttagactgctctcacaacttactcagcatcaaagtattcacactggtgagaaaccttatgaatgtaaggaatgtagaaaaccttttagactgctctcacaacttacccaacatcagagtattcacactggtgagaaaccttatgaatgtaaggaatgtggtaaggcttttagactttattcatttcttactcaacaccagagaattcatactggtgagaagccctacaagtgtaaggagtgtaagaaggcctttagacagcattcacaccttactcagcatcagaagattcataatggaatttaatagaagaaagccttcaaatgtatatgatgttacagaacatcagaaaattcatttttgagaaaatgtgtttcatgctcaattccaagcataataaattttatattagagaaagaatatgttgatttaaaagccttccaacaccatttaaacatggtttatcttcagcaaattcctatgagagaataatgtaatgaatgtaggaaaatctttagccttatctgtcattatctccctttctccacttgattaccagtttgatttattggacaagatactaagcttctgtgcctcattttgctgacttgtaaaatggtaataatagtacttatatgtattagttatttattgctgcgtaataaattaccacagacttagtagcataaaataacatataattatatcttataatttggatcaggagtataggcatgacttagttgggtcctctgcttcagggtctcttgcaaggctacagatttcagccagggctgaggtctcatctgaaggctcaactggggaaggatccacatccagactaacatagttgttacccaatgtatttccgtgaggcctgttgcattgagattctcagtttctagctggctgttggctgaacgctgactgcagctcctggccacaatagcctcatcaacatggctgcttgcttcatcaaggcatgcaagccaaaagggaggacagtctgctagcaagatggaagttaccatcttgtgtaatctaatcatggaagtaacattccctcaccttctactggtagaagtaagttactaggatagtccacactcaagagaacgggatgatacaagagtgtgaataagtcctggagacaggaccactggggggcctgtttagagtcagcctgccacactgtggaataggattgttgcaaggagtaagtagttaatacttggaggaatcacagtcatatagcatgtattctgtaaatattatctgtaattgttattattgtcattagtattagtgaattcacgtaaaaggaagatctgtagacataataaatgtagaaatgcctcctgtcacctctcagaaattattaaacataatttattctaggtaaaatttagattgtagtgaatgtaggaagttcttcagcacttgagctgcattagaaatttcatgccaaaaatgaatttcatgaatgtgaggtcactagtaatacagctgttgaagaattagagggaaataggaaatgattttcccataattccagaaagcaaaaggcttacaatccctgttgtctgaccacagtttaaaattaattagaaactatcaaaaatgtggcttaaaagaaattaaccacctaggaatttaatattgttgtgtatatttatgtgtgtgtataaaactcctgtgggaaagaaacaaaacatcattctataagtcagtatacttttggatgctcaaaatgccatatcttcaaccagtaggagttgtttcaagttgagtttttgatgtgatcccaccaataatttgatagtttacttgattgtggctgcataatttggtaacctatgaaagatgctagagcaccaatgtataatttttttgagacagggtgtcactttgtcccccaggctggagtgcagtggtacaagcacagttcactgtaccctgttcctcctgggctcaagtgattcttccacctaaattttttttttttttttagagaaagggtctcactatgttgcccaggctggtcttgaacttctgggctcaagtgatcctccctccttggcctccaaaggtgctggggttacaggtatgagccaccacacccagcccaactcattattcttgaaatcaataaatcagaggaaaaattgtcatttagtttccttttcccatgtgaaccaaatttcagggtcaccagaagttcatcaaattcaaatgaatttggcctggcacaggggtcacacctgtaatcccagcactttgggaggacaaggtgggtggatcacttgaggccaggagtttgagaccaacctggttaacatggtgaaaccctgtctgtactaaaaatacaaaatttagccaggcatggtggcacacacctgtagtcccaggctgaggtgggaggatcacttgaacccaagaggcagagtttgcagtgagctgagatcgtgccactgcactccagcctgggtgacagagtgagaccctgtctcaaaaaaaaaatttgttttttgaatgggtttttcttttttgaagaagtctaataaatctagaaggaattagaggattagaaaaatcaccattttctagaccttaatggaataatgggtccagaaaacatgatcttcaatgggtactacaactaataggtgaaatattttatagcgagatttttatggtggatctatcaaactggccacctctgaaccctttgatctgttttaaccttaataaaaatgggtctatcagacaacacacttcctgacgtaatgcaataggaagtccacaccaccatctacaaagccttattgctggaataatgaactgaaagcagacagggactagatgaacagtatatggtcatcccttggtatccatggggaattggttccaggatcctccactgatggtaaaatctgaggatgctcaagtcccttgtataaaatggcatagtatgtatttgcatattacctactcacatcttcctgtatactttaaattatctttagatcacttatacctatcacaatgtaaatactatgtaaatagttgttatactgtatttttcaatttgcattatttttattgtattttatttttattgtttttttttgagtattttctatttgagattggttgaatctgcacatatggagggctggctataaagggcaccacaaggaagaagccaaacagatccagaatgtgtgaaattctacagagcaaattacctgatttcttcaactaacaggtagcatgaaaatacaaggggaagggcaaccattaacagattaaaagagacttaaagagacatatcaactaaattcagtatgttggcattacttggacctggtttgaacaaaacataaaaagccattttggagacagtgagggaagtgtggacatggactaaatattaaatgatatttacatatattaatttggttagggattatgtcagtgtgattataaaaaataaaagatcgtatgatatgagatacatactatgaaatgaagatagacacatttggattaaaatattctagcaaaagaaataattggcaaagagagctggaaactaaattggcaacatgttgataatttaagtggagtgttttgttcatggagacttattgttctaatatttctacttttgtatgtgtttgaaatttcaataataaaatgtttaaaatcaaaaccaaaattatagactatgtagaaatgaatgacagtgagatgcctgcacatctaaccttgtcagatataatcaaagttctgttcagtgacaaattaatgccctgtaatgtggtaaggaaatcttatttgtggatacagtcttcatcttcttcacttacccacagcagcaacaccaggcctgtcacacagatgaatgtgttgagggaatgaataagtatttccgtcaagaaaaaggaaacaacaaaataaaaccaacccaagtaaagaacagccaagtggccaggtgcggtggctcatgcctgtaatcccagcactttgggaggccatggcaggtggatcacctgaggtcgggattttgagaccagcctgaccaacactgagaaaccccatctctattaaagatacaaaattagccaggcatggtggtgcatgcctgtaatcccagctacttgggaggctaaggcaggagaatcacttgaatccaggaggcggagtttgtggtgagttgagatcgcgccactgcactccagcctgggtaacagagcaagagtctgtcaaaaaaaaaaaaaaaaaaaaaggaacagccaagtaacagtagaaagtagaaattaagagaatggagaatattagacttgattcaatgttaatagtgattagattttggcagttataatcaaggaagagaaaatgaaagataatacatttagagtattaatgatgataaaagagacacaactctagattatatcaagcagatttttaaaattataaggcaaaactaggccgggcacagtggctcacacctgtaaccccagcactttgggaggccgaggtgggtggatcacttgaagtcaggagttcgagaccagcctgaccaacatagcaaaaccccatctctactaaaaatacaaaaattagcctgtcatggtggcgggcacctgtaatctaagctactggggagcctgaggcaggagaattgcttgaacccaggaggcagaggttgcggtgaaccaagatcacgccactgcactccagcctgggtgacagagtgagaacctgtctcaaaaataataaacataatatggtaaaactatacatgcacacatgcacaaacgtgtatattcattccagtacaagtaaaaatgtaggattgcatttttcccccaaaaggaatatgttttacaattaactcaccgtataacccaaatagattaacaaaaaatgtgtgtgtgtgtgtgtgtgtgtgaactccctgtttaaaaaatctgatacttataaaaactttaaggaatagataatcctaaagattttaccaattaattctgcaaggtaaaataatcctaataaaaattagatgaagatagtttctgaaagcaaattctagaccaccttcattatgaagattctatttttcacaattctaaataaagtttatttagaatttattacaaaatctatctttgctaataggtcagtgtttcttttcccaagcaccaaatacctccagaaagcctgtgtttgacccctaaattcaacattctccagaagtttgcttcaaggaatattaattctcgatggtatttgaaaaaaagatttcttgggaaaataggcaaatgaagcaaaacataaaacatctacttttggccaggcacggtggctcacgcctgtaatcccaacattttgggaggccaaggcgagcagatcacttgaggtcaggagtttgagaccagcctggccaacatggtgaaaccctgtctctactaaaaatacaaaattagctgggcgtggtggcttgcacctgtaatcccagctacttgggaggctgaggcaggagaattgcttgaacccaggaaatggagattgcagtgagctgagattttgccattgcactccaacctgggcaacaagagtgaaactcagtctcaaataaaataaaataaaaatctacttttgaggaattcaaagtatacatgatcagtttgccaaagatttagtaaagacatttttatttaactgagtgtatctcaaatttattgtggaattctcagtccgaatatctggaataggaacagctttgttagatgctaccataaccacaatgaatgtcttcaagggtgtaattttagatatggtgagtggttgtgttgggggcggcataagtcagggcaattttttgcagctcatatcatgctctgaaagtagctacctgctttaatggatggttagtgcttttctatagaatggaaaagattccagcccgatccttgatatgtttgtgttaaacatgcttatatattatattaaacaatgattaaggacataaatgagtttctgtggtaataaagatgctatattgaatatca

SEQ ID NO: 200783 - DNA, 642 bp, Homo sapiens
  Payload ID: 19624
  Gene Name: ZFP14 zinc finger protein
  ENST ID: ENST00000589280
  CDS Start-End: 82-327
agctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactagcaggaccttccatttctaaaccagatgtgattaccttattggatgaagaaaggaaggaacctgggatggttgtgagggaagggacaagaagatactgccctggtgagtgagggctgagcaggcattgagaaatcactactgcaggtaatagctaaactgattagggtggaggcacacccttgagatgttggggtctctcttcaaaaagcccctggcctatggaggcagggcttgggacttgaagcaaattaagatcttttaagcctggactagcaaaggaactttctattgatcttgaatgcaacactgtttctcatctttcatatttctatcctactttaaagagaagaactattcctggtagaagaaaaaataaataaatataagagcagaaatcagcaaaatagaaaagaaataaagaaaat

SEQ ID NO: 200784 - DNA, 2429 bp, Homo sapiens
  Payload ID: 19625
  Gene Name: ZFP2 zinc finger protein
  Uniprot ID: Q6ZN57
  ENST ID: ENST00000361362
  CDS Start-End: 531-1916
aaatgtagtctggcgctccgggctgtaagcgccggtcgcggctgtgtcggtcgccgctgctcccgctcctgctgggagaggtttcaggagtcagtgaccttcaaggatgtgtccatagatttctcttgggaagagtggattcaagcagattctgctcagaggatgaccgtgtatggggaggtgatgctggagaactacaggaacccggtctcactgggaaatcacctttccaaacccaatgggacttcccagctggaacgagaactgagtctgatgcaaaaagaaccgcctgagggtggctttcgagattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggtatgtagtcctaatctgccactgccttggacaacttgcctacttccaccaggttatggttctttatttggtaaatgaatgattttggagttagaaatcttgtaggagctctgttagctctaaaatgctacaactctataaatataatgaatgctgggaaa

SEQ ID NO: 200785 - DNA, 598 bp, Homo sapiens
  Payload ID: 19625
  Gene Name: ZFP2 zinc finger protein
  ENST ID: ENST00000520660
  CDS Start-End: 530-598
gtagtctggcgctccgggctgtaagcgccggtcgcggctgtgtcggtcgccgctgctcccgctcctgctgggagaggtttcaggagtcagtgaccttcaaggatgtgtccatagatttctcttgggaagagtggattcaagcagattctgctcagaggatgaccgtgtatggggaggtgatgctggagaactacaggaacccggtctcactggcaggaaatcacctttccaaacccaatgggacttcccagctggaacgagaactgagtctgatgcaaaaagaaccgcctgagggtggctttcgagattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattctactctaggggaaacctgggaacctaataattggttagaggga

SEQ ID NO: 200786 - DNA, 2154 bp, Homo sapiens
  Payload ID: 19625
  Gene Name: ZFP2 zinc finger protein
  Uniprot ID: Q6ZN57
  ENST ID: ENST00000523286
  CDS Start-End: 415-1800
cccggtctcactgggaaatcacctttccaaacccaatgggacttcccagctggaacgagaactgagtctgatgcaaaaagaaccgcctgagggtggctttcgagccgggcatggttgcgtgcacctgtaatcccagctactcgggaggctgaggtgcaagaatcacttcaacccgggaggctgaggttgcgattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggt

SEQ ID NO: 200787 - DNA, 2043 bp, Homo sapiens
  Payload ID: 19625
  Gene Name: ZFP2 zinc finger protein
  Uniprot ID: Q6ZN57
  ENST ID: ENST00000520301
  CDS Start-End: 304-1689
cccggtctcactgggaaatcacctttccaaacccaatgggacttcccagctggaacgagaactgagtctgatgcaaaaagaaccgcctgagggtggctttcgagatggagtctcgctgtgtcacccaggctggagtgcagtggcacaatctcagctcactgcaagctccgcctcccgggttcacaccattctcctgcctcagcctccggagtagctgggactacagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggt

SEQ ID NO: 200788 - DNA, 532 bp, Homo sapiens
  Payload ID: 19625
  Gene Name: ZFP2 zinc finger protein
  ENST ID: ENST00000520805
  CDS Start-End: 507-532
gctgtaagcgccggtcgcggctgtgtcggtcgccgctgctcccgctcctgctgggagagggagtcagtgaccttcaaggatgtgtccatagatttctcttgggaagagtggattcaagcagattctgctcagaggatgaccgtgtatggggaggtgatgctggagaactacaggaacccggtctcactggcaggaaatcacctttccaaacccaatgggacttcccagctggaacgagaactgagtctgatgcaaaaagaaccgcctgagggtggctttcgagattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattc

SEQ ID NO: 200789 - DNA, 4096 bp, Homo sapiens
  Payload ID: 19626
  Gene Name: ZFP28 zinc finger protein
  Uniprot ID: Q8NHY6
  ENST ID: ENST00000301318
  CDS Start-End: 72-2678
cgggcgggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggccagcgatctgtacatgagacccaggaattatttccaaagcaagattcatatgctgaaggggtaacagacagaacctcaaacactaaacttgattgttccagtttcagagaaaattgggattctgactatgtgtttggaaggaagcttgcagtaggtcaagagacacaattcaggcaagagccaattactcataacaaaaccctctctaaggaaagagaacgtacatataacaaatctggaagatggttctatttggacgattcagaagagaaagttcataatcgtgattcaattaaaaattttcaaaaaagttcagtggtaataaaacaaacaggcatctatgcaggaaaaaagcttttcaagtgtaatgaatgtaagaaaacttttacccagagctcatctcttactgttcatcagagaattcacactggagagaaaccttataaatgtaatgaatgtgggaaggcctttagtgacggctcatcctttgcccgacaccagagatgtcacactggcaagaagccctatgagtgcattgagtgtgggaaagctttcatacagaacacatcccttatccgtcactggagatactatcatactggggagaaaccctttgattgcatcgattgtgggaaagccttcagtgaccacatagggcttaatcaacacaggagaattcatactggagagaaaccttacaaatgtgatgtatgtcacaaatccttcaggtatggttcctcccttactgtacatcaaaggattcataccggagaaaaaccatatgaatgtgatgtttgcagaaaagccttcagccatcatgcatcactcactcaacatcaaagagtacattctggagaaaagccttttaagtgtaaagagtgcggaaaagcttttaggcagaatatacaccttgccagtcatttaaggattcatactggggagaagccttttgaatgtgcggagtgtggaaaatccttcagcatcagttctcagcttgccactcatcagagaatccatactggagagaagccctatgaatgtaaggtttgtagtaaagcgttcacccagaaggctcaccttgcacagcatcagaaaacccatacaggagagaaaccatatgagtgcaaggaatgcggtaaagccttcagccagaccacacacctcattcaacatcagagagttcacactggtgagaaaccctataaatgtatggaatgtgggaaggcctttggtgataactcatcctgtactcaacatcaaagactgcacactggccaaagaccttatgaatgtattgagtgtggaaaggcattcaagacaaaatcctcccttatttgtcatcgcagaagtcatactggagaaaaaccttatgaatgcagtgtgtgtggcaaagcctttagtcatcgtcaatcccttagtgtacatcagagaatccattctggaaagaaaccatatgaatgtaaggaatgtaggaaaaccttcatccaaattggacaccttaatcaacataagagagttcatactggagagagatcttataactataagaaaagcagaaaagtcttcaggcaaactgctcacttagctcatcatcagcgaattcatactggagagtcgtcaacatgcccctctttaccttccacgtcaaatcctgtggatctgtttcccaaatttctctggaatccatcctccctcccatcaccatagcctcgagacgtcatttctgtttgactactccagcagtttaaaaccccatctccctgcccttttgttttctttttgtcccttattagttagttcttcacataagtgtaaatgtaacttattcactcctcttgtaaaacttatagtttctttaaattggttaatgtgtgagatgtgctcagcacagtgcctggtccatagtaagtgctcagtaaacttagctgttttaaaaactttgtatttgaacattgaaaagttacagtagtcagctctgataaaaaaatgatgcagtagggtgagggtaggaaaaagcacattttctatcaggaacagaattctccagtagtgggtgaggttttgcctttgttggttttaaaacttgattctataatgccaagttagttttgtggctttccatctgaccctatgtgaatgtaaggtgatgtgaccttgttggtgagaaaattaaactttacatttgacttgatttgttttagaaagtctagggaccatgaatgaataggccagctgggacaaatgaatttaaaaaatcagaaaaatgcaagatttatatgcatgaagttaaaacaactgacgttactcaagaattagaaaactttgcaagatttgacttgtttaaaaatcacatttataagtgaaccgtattaaaacttttaaggaaccattcattgtgaggtaaactgatccagaataggggtcagcaaactatgactcatggccacagtctcactgactgtttttgtatggtccatgatctagaatttaaaaaaattttaaagggttgaaaaaagtgaaaagaatattttcaacatgaaaattatatgaaatttaagttttggtgtctgtaaataaagttttgttggcttcagccacacagtgatttacaccttgattgtgctgcttccaggctgtagcagcagagttgagcagttgtgacaggagaccatgtggcctgcagagcccaaatatctactgtctgatcctacacagaaaatgtgtgtgatccctgctatggagcagaggttatcaaactaaagcccatggaccaaatcctatctgctgcttgtttttgtaaatagagttttatcaaaccacagccatgcttacttgtttagctattgactatggctgctttagacaactgtgacagactatatggctcgcaaaactgcaaatatttcctatcctttaacagaaagtttgccaacctctgctctagagtagagaaaaatgtataaaagattttaattttatgagggcaatacaactgtcacatcagaaacaagaaaacaaatgataaaggaactcatttatcaatagaggtgaaaggaaattattaaactatattgaaaaataaagatgtcaataaaaggagaaatgatatttttctagatgaaata

SEQ ID NO: 200790 - DNA, 533 bp, Homo sapiens
  Payload ID: 19626
  Gene Name: ZFP28 zinc finger protein
  ENST ID: ENST00000589836
  CDS Start-End: 1-441
accttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagatcattcatctcttcttgagactagttaattgtgaagacttacatttttaaggccaggatctggacttttattagttagcatcgtaataaaaaaaaaggagacttgaaggctgtgtggaag

SEQ ID NO: 200791 - DNA, 3475 bp, Homo sapiens
  Payload ID: 19626
  Gene Name: ZFP28 zinc finger protein
  Uniprot ID: Q8NHY6
  ENST ID: ENST00000591844
  CDS Start-End: 67-1116
gggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggtgagtgcaggagagcctggtgtggaaaatctactgcaagagagagcggagcttttaccaaaaaggctgcatcctcactaatatacagtaggaaactttacccagggtctctgggtctggaaagaaaattgaactctgggagttccaaataattctttcctcctcctttgcccccttctctccagtaactgccatttccctgaagttccttcttttcttggccactgggacgtgtatcatccacttgcttccttaaatgatcttttctggaccctgatgcacttttgagctgacttccaaaggttttctcttctgtggttaaatggcctattgttttcatcatgcatccattcctgtgagaaccacaaattgaaagttatgggattgagccactctgctgagtattggcaggcgattggaaaaagggagaattacacataaatgtaagccatcagtgaattactctaatggaaaggataagacatgtttatggatagcttgcatgaagtagagtttgcagaatttcaaatagggcattatagagacaaaggagatgttgttcccagtggtgtctatgttttagtaggacaggtgggtagaagttgaattgcaagaaggtggaagtaaaggatcttttcctcttgatgcacaagggaaagaaaggaaatttccatagaaaataatggtttgtagaaaatgtaattgtttactgtttggcaaaagaatataaaaccgtgacgttatcacaacatacaccttagatccatttaagtcaggataaacacacattttttcacatagtagaaattacagtgtatattcagttacgcatacacgtttttcatgtggattccacgttgtatataccattgctcacttaggttgctttacatttcttagtattaaagatacaattataatagatttttttcaagttaagtgaaaactacacattttggggattgctgtattcctggatatgagcacctgctaggctctgaaagtttttttgtttttggtgactagcaacaattagatgtatgagtttaattgcatcttgaaagtattggttatttacatgaaaacttttgctcattatttgttgaaagattatacactaaaattattctttttttatgaaagaagttgaacattttttcgtaaatttggtttttctcttatcttcttgtaaaatgtctgtcatttgtacccagttctctcttgtgtgttaaatattttcttaacagtctcagtgactgctatgtatataagcatactaattctgtgatatattgtctcaaactattttcacatatggcaataagagttttaattttaattaggtcttttaaaattatgacatgtaaaaattttcaatttttatatagtccagtatattatttctaatgtgatttctcctatttgtgtggctaacaacttgacacatatagttctatttcatttttaatgactatttagtattatatgaatatatataatttatttaaattatttactgttgagtatatttaaacatttaggaggtcttctccagttttcacctataatcaacagtggtccagtttgtacatatcttcttgcttacatgtcagaatatttcttgaagatatatgcttggaaatgaatttgcatggtcgaagtatatgtatttttaaagtgtcatggatattttgctgtaccgttggtaaagaatatatgagaatactgtttctagacatcatcaccaatatgggtattttgtagtttaaaaaaaattttgccaagctgctagatgaaaaatgttttatttaatttgcatttccccaactacttacgatgttgagaatatgtgctcttaaatctgtttagagtttgtattctattcatagtgtgtttatactcattagtcacatttctattgggttgtatattttcctgtatttatgcaacattgatatgaatgctattttttaataagtttgataaaatttttccccaattttgtgtggtctagaagtttgcatatggtatttcttactatatagtagcttaacttgggaattatcttcatttatagaagcacgtactttgttgattttttcatttgtttcactcctatctcttaaaaaatgaatagatgtatagtcccatttgaatcatataatacatttgtttgaccttctgtaacttaattatttctctctcctttatcaccttccttccttttctttctttccttctcatttttcccttctttccttacctttctcttctgtattttgctgtgtggcctgttttttgtttgttttatttacatatttttattatagaagagtacacataaaatttaaccattttgaagtgtacaattcagtgacagtatattatgtgaggtgatatggtaattagcttgattgtggcaaacatttcaccatgtataagcatatcaaaacattttataccttaaatatatacaatttttatttgtcaactatgcctcaataaagctgg

SEQ ID NO: 200792 - DNA, 5206 bp, Homo sapiens
  Payload ID: 19627
  Gene Name: ZFP3 zinc finger protein
  Uniprot ID: Q96NJ6
  ENST ID: ENST00000318833
  CDS Start-End: 337-1845
atgattccggggctgaagtgggcatcgacgggtgcactttgctgttccagggagccggctcggcaggcggcggcgacgtggaacttgggctagggctagaaccggcgaaaagcaagccggaaaaggcaagggggcgtcggtgcgctgaccacctgttcctccagcggagtgcgacgcgcgccgattggctggagtgccgcccgggtaccggaagtggccgatgcccgtcgccagtgacaccgggacaacagctgcgggctctgtgcgagcggcccagcagcgcggagcctcagcggagtgagcgagcgcggggcagtagcggcctgcgattgtgagatggggactgagaacaaggaggtgattcccaaggaagaaatttctgaagaatctgagccacatgggtcattattagaaaaatttccaaaagtggtttaccaaggtcatgagtttggagcaggatgtgaagaagacatgttggagggacattcgagagagtccatggaagaggttatagagcagatgtctcctcaggagagagactttccatcagggttgatgatctttaagaaatcaccctcaagtgagaaagaccgggagaataatgagagtgagagaggctgcagtcccagcccaaatctggttacacatcagggagatacaacagagggagttagtgcatttgctacctctggccaaaacttcctagagattttagaatctaacaaaacacagagaagttctgtgggagaaaagcctcatacatgtaaagaatgtgggaaagcctttaatcagaactcacatctcatccagcatatgagagttcatagtggagaaaaaccctttgaatgtaaagaatgtggaaagacatttggaactaattcaagccttcgacggcacctgagaattcatgctggagaaaaaccctttgcttgtaatgaatgtggaaaggccttcattcagagttcacaccttattcaccatcatagaattcatactggagagagaccctataaatgtgaagaatgtggtaaagccttcagtcaaaattcagcccttattctacaccagagaatccatactggagagaaaccatatgaatgtaatgaatgtgggaagacctttagggttagttcacagcttattcagcatcagagaattcatactgaagaaagataccatgaatgcaatgagtgtggcaaagccttcaagcatagctcaggccttattagacaccagaaaattcatactggagaaaaaccatatctgtgtaatgaatgtgggaagggcttcgggcagagttctgagcttatccggcatcagagaattcatacaggggacaaaccctatgaatgtaatgaatgtgggaaaacttttggccagaactcagagattattagacatattagaattcatactggtgagaagccctatgtatgtaaggaatgtgggaaggccttcagggggaactcagaacttcttagacatgagagaattcacactggagagaaaccctatgaatgctttgagtgtggaaaggctttcaggcggacctctcaccttattgtccaccagagaattcatactggagagaaaccccatcaatgtaatgagtgtgcaagaaccttttgggataattctgagctgcttctccaccagaaaattcatattggagagaaaccttatgaatgtagcgagtgtgagaaaacatttagccagcattcccaacttatcatacatcagagaattcacactggagagaagccttatgagtgccaagaatgtcagaagacttttagtcggagctctcacctcctccgacatcaaagtgttcactgtatggagtaatctgcaaaataggaaagcttttagtggaaaagctaaagtccaacttattcatttgttcataatatgcaaatatgcaccccaagtattcaaatccaatgaatggacagaacctcctctgtcctcccactgattttaaatagttggttgaagaagatgaggcacttttttttttttttttttaagcattggggtcttgctctgttgcccaggatgggatgcagtggcacagtcgtaactcactgcttccttgaactcctgggctcaaacagtcctcctgcctcagccttccaaatagctaggactgcaggcactaatgaggcacttttatgaattattcattgagaggtttcagtgtgctaagttaaatcataaaagctctttcaggccttaatttcccctctgtccttccttccccttctcctcccccagtggatcacataacaaacattaagggtctgtaccagccatctttcctaaattactcttcagcaaaattgtgggaacaggattccaccacctcctaagaatgagagttgactcattgactgttaccccctgaaatattagaaagtcataatttagaagacacacctcattctcctgtccactgtttagcattggaataatttagtaagctgttattagcttcaaagtcgtccagccctgctatgaagttactttagaagatggcagcattaatgaagaagcaggctcatttcacatctgtcaggcttccttattcatctgaagaggctgccatgatggaggaactgacaggcaatttacaacgggattataagtgaaggccttagaatccagaggggccgattaggcaacaccaggggataaacaattgaggtcacactgctcggcatgggcagaagcagctcttcaggagctgtccacacttcaggggtgctcagactgactgctcctaagaattctgctgcatatatttttagccccatctcctgccactgctgacagatattgtgacagtaagtagcagacaggactgtggcttcacctcctccgggcacctggctacagtgatgagtcagttcacctgatgacaaaccagggtctggccttgccaaagcacttaagttctcatgacctggaccgcactggaggccctggctaagtcaggatgtcgtagcctcttcttggttttgccccttggccttgaaattcttttttcttgaataactttaaaaaaatagagataaagtcttgctatgttgcccaggctggtcttgaatgcctgggctccagcaatctttttgcctcaacttcccaaagtattgagattacaggtgtgagctaccatgcccggccttgaaattctttcttcgctatgtctgcatgttttttgtgttctgtatttatttcttctccaaggaaacagcctacattttccatgtgtccatgtttctgaggccgtgggtgacagtgggaattgcactaatgggggcccaacaggcctgggggctggtcttagcgctagaccttgaacaaggcacttcacctgctggtctccaattttctcctctgtaaaatgaaagagttgaactaagtgatctcaaaagtttcaaccagcccgataattccttaattctttaaaaatttaactttatatatctttattattctttaacctcatctttgttacactaatattagtcactaatatttattgagtgtttactacctgacaggcagagtgccagtttacattttaattttcacatcatttctatgatgtgggtactcatttttttaaagctttatgaaggtataatttacgtactataaaattcacctgttttaagtgttcagttgaatgatttttaatttacatagtggtgcaaccatcaatgatgtgggtattcttaccccaatttaaaagataagaaggggcagtgttaagtaattgacccatgattccacagctagtaagagcgacagccaagactccaaacctggttgatgctcttaaccactgtgctatgccgcaggtaggcagattcattactgccttatctgaaaccctttgcacagtttctattactgatttctatgtagatttgaatataacaaatttaaatcatgtccttggtaacagaactgatcacagccaaaaaaaattcaccaaatgggtttattctgtactccaatataggtgtcttcccaggtttatatccttggcttgagaaaagggttgtacaaatagatgattgcagagtttccacatccttccagatacctctgcctctagcagtcacactcttagtaagggaagttgtttgatttacttcttcccttaggttgattacaagtgaagtgcgccgtcttattcctttttcattgctggagcacaaattgaattgtgcccagaccgtatctttctcacatgaaacctggatctcacctatcccttccatgcctgattcccgtgtttgcatattttatttccacatttacctcttgtcagccctgacagagaatttggcaccccttcaagcttctcctaaacaatctatgcacacaaacacccctgagcaatatggacttcactgaagatagtgtgtaagcaaaggagaagagttcacattgtgcatcctattagacattttgttctcagaagtaccttactggccaaaccaatgaaggttttcctcttgtcctcccctctcaaggctcagtcacctcaacttctttttgcctactagatatccaatccatcacctcgcctcccctggccctagctcaattaccctcttaaacccattcctgctcagcaaaacttcctctagttcaccattcattcatttgaacattaggaggcaatttagtgacctgttgtacctgaccatgttcttaagggggaggtctcacgtctcattcccagaaaagtctaccatatatagatacatattccccgccccgccccagatttctggtgaatgaaatcacttgtatcttattaggtacatatacgcaaatccttaacctcaattctctgtcctcttcatgtcttacccagatatctcaggaagatttctcttttccttctgtttgcctccctcttcgacttacttgggagtcagcatctgaccacagtcgtgactggtaatgatgatttgtgcaaatactatcaaggaaaggacatgaattgtcttaattttagacccattaaaaaaccgcacaggcctcaatcttaaaagtcctatctaaatacccagaaatacccttcagaatttttgaagctatgcccatgtacaaaattttcttccttccctaattttaatggtatactaacaccttaggtaaataaaatatttctttactattttattga

SEQ ID NO: 200793 - DNA, 6090 bp, Homo sapiens
  Payload ID: 19628
  Gene Name: ZFP30 zinc finger protein
  Uniprot ID: Q9Y2G7
  ENST ID: ENST00000351218
  CDS Start-End: 559-2118
tggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggcccggtggctcatgcctgtaatcccagcactttgggaggccggtgggcagatcatgaggtcaggagttcgagaccagcctgaccatcatggtgaaacctcatctccactaaaaatacaaaaattagccaggcgtggtcacatgcgcctgtaatcccagctactcgggcagctgagacaggagaatcacttgaacccaggaggcagaggttgcagtgagccgagatcacgccattgcactccagcctgggcaacaagagcaaaactctatctcaaagaaaaaaagaaaatttctacatattaaaacttgtggatgttgccaaagctctacacattgggattggaatattaattacactataatgacgataatgtattcaggaagttaaaatgtaggtccacattttatttagttgacctctctatctctatattatagtacccatggtatgcaccttttttttttttttttttgagacggagtctcgctctttcgcccaggctggcgtgcagtggcacagtctcggctcactgcaagctctgcctcccgggttcaagccattctcctccctcagacttccgagtggctgggattacaggcgcccgccaccacaccaggttgatttttgtatttttagtagagatggggtttcaccatgttggccaagctggtctcaactcctgacctcaggtgatccacctgccttggcctcccaaggtgctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttggtttttttgtgtgtgtttctttaaaagataccaatatagtcaagacctttgcagttttgatcacagaaatatgaaagattacacagctacagctatatgaatgataaaagtgacagctatggatttttaaagttataagttgctatactacatatatgtaatgtgtgtgtgtatagtgtgtaggtatatatatttatatttatacacacactatacatgtattttaaaatattgaaaatccagaattattttatggtaaaaattactaaaattgacttcacatgctgaatgaagagagcctgagtagaccaacaaacaaatgaaaaattaagacggttagaagatacgctttctaaaagaatacatttagaatctaactttaaaaaaaaaaaatcctactctcctgagccagagtggtctcagagagactccgagaacctaattttttacaagtaaaatctttgaagaattggtaattgctaaatttttccaacatactattctacaagactaacctaaaactgattataagaactaggtgaggagggctggcaaaacgaaaatctagacattttccgtatgaagagaaatctggtaattctaatttctatgggaaattatatccaacagtttagaatagaaaatcatttatgtggaataacttggaccagatccatccagctttaattatatatttagattctaggcattctaccttcagaacatcataatgatagtaaaagagatacgattctggcccagtatcatctcaattcatgcttattgtcttttttttttttttttttttagctttctatgtattaagaatggaatgaattttatgtatgtaaaagtgtaacccaacaccttaaaattaccttctcaaaattaataaagacagagttcttataaatgattgcatcagttggacttcggtgatttcaccgtggtcatccattatgaactgtatttgctgttataattgggaagccatgatgttcagtgtattacatcattatattccatttctcaaatggaatatgaaacttgatagcatttgaaaccatttcccaggaaacactagtgcttgatggtatttttagaaagcattctgtggttaaatgagcatattaaaattaataattaagaaaataaaactatagcttctccaaataatgaagtaatgagagtttaattgattttatttaacttaatgtatctgaagcaccttttaccctgtaactttcactcttaatgcttgtgagtatgggatatgaacccattttaacagataagtgctgtaaccaaaacaggtgacagcaaaggtggaaagttcggacctcatgtcaggtggttagttgtgttggaaggtggatgtgaggtatgtttccctggatgtggcatcatgttctaaagtcacctgttctttctgaatattgaactgttgcttttctgcagaaataaaatttctgaatcaaca

SEQ ID NO: 200794 - DNA, 3916 bp, Homo sapiens
  Payload ID: 19628
  Gene Name: ZFP30 zinc finger protein
  Uniprot ID: Q9Y2G7
  ENST ID: ENST00000392144
  CDS Start-End: 588-2147
gtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttggggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttgg

SEQ ID NO: 200795 - DNA, 4440 bp, Homo sapiens
  Payload ID: 19628
  Gene Name: ZFP30 zinc finger protein
  Uniprot ID: Q9Y2G7
  ENST ID: ENST00000514101
  CDS Start-End: 388-1947
acagccagcgtcagagtcaggcaccaccgcgcagccttctctgcggcaccatcctaatcccccgctagagaacggcacacgcgcacgcagcagccccgtgcacggaaacactactccgccagcggccaggcactcggtccaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggcccggtggctcatgcctgtaatcccagcactttgggaggccggtgggcagatcatgaggtcaggagttcgagaccagcctgaccatcatggtgaaacctcatctccactaaaaatacaaaaattagccaggcgtggtcacatgcgcctgtaatcccagctactcgggcagctgagacaggagaatcacttgaacccaggaggcagaggttgcagtgagccgagatcacgccattgcactccagcctgggcaacaagagcaaaactctatctcaaagaaaaaaagaaaatttctacatattaaaacttgtggatgttgccaaagctctacacattgggattggaatattaattacactataatgacgataatgtattcaggaagttaaaatgtaggtccacattttatttagttgacctctctatctctatattatagtacccatggtatgcaccttttttttttttttttttgagacggagtctcgctctttcgcccaggctggcgtgcagtggcacagtctcggctcactgcaagctctgcctcccgggttcaagccattctcctccctcagacttccgagtggctgggattacaggcgcccgccaccacaccaggttgatttttgtatttttagtagagatggggtttcaccatgttggccaagctggtctcaactcctgacctcaggtgatccacctgccttggcctcccaaggtgctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttgg

SEQ ID NO: 200796 - DNA, 583 bp, Homo sapiens
  Payload ID: 19628
  Gene Name: ZFP30 zinc finger protein
  ENST ID: ENST00000588979
  CDS Start-End: 414-583
tccaaaggttccggtgaggcgtcgctgggggcggggcggggctcgcagcctccgcctgtctccgagccgagaaccaaatgaaaaataaaaaggcggaatattgtttttttaaattttggaccgcagtgtccacaggggagcaggcctggattatctttaatggcactggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcac

SEQ ID NO: 200797 - DNA, 572 bp, Homo sapiens
  Payload ID: 19628
  Gene Name: ZFP30 zinc finger protein
  ENST ID: ENST00000587809
  CDS Start-End: 200-572
gtattctggcgccgctgactcccagggctgggctatcctctgagtcggccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactgggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttca

SEQ ID NO: 200798 - DNA, 557 bp, Homo sapiens
  Payload ID: 19628
  Gene Name: ZFP30 zinc finger protein
  ENST ID: ENST00000587199
  CDS Start-End: 548-557
atgtattccgggctaccagcccacaaacgcggcggaaccggttgcggggaggttgcttgaattctctcagctgcgccccctgacctagtagtcgctggcacaagctgcgcccggagacgtgggagcgttctcttgttttccgagtgcgcggactcatcgggtcacagtttatgcttttatgacgcgggaacacaacagatttgagaagcctcggattaaggaataatttatgaagctccgttgactaccgtggagagatcataatttggggttcaagattccagggacccacaaaccgtctccatggaaaaccagaaccagaagcgctgccctatcagaaggattctggaaataacgctggatgaggcagagccacagtcacagatccgatgtcagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtg

SEQ ID NO: 200799 - DNA, 444 bp, Homo sapiens
  Payload ID: 19628
  Gene Name: ZFP30 zinc finger protein
  ENST ID: ENST00000589018
  CDS Start-End: 96-374
tctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactgggatgttctatttctaagccagatgtgatcaccctattggaacaagggaaagagccctggatggttgtgagggatgagaaaagaagatggactctaggccctaccttcaaataccatcaccttgggattcgtgtttcaacataggaattgttacgggaacacaaacattcagcccataacagattttatcaaagaagtacttcatgaaatgtaa

SEQ ID NO: 200800 - DNA, 521 bp, Homo sapiens
  Payload ID: 19628
  Gene Name: ZFP30 zinc finger protein
  ENST ID: ENST00000591444
  CDS Start-End: 515-521
ggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttgggccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctc

SEQ ID NO: 200801 - DNA, 1786 bp, Homo sapiens
  Payload ID: 19629
  Gene Name: ZFP36 ring finger protein
  ENST ID: ENST00000597629
  CDS Start-End: 75-1073
ttcctataagtagccggctctcggtgccagcctcagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaagctgg

SEQ ID NO: 200802 - DNA, 444 bp, Homo sapiens
  Payload ID: 19629
  Gene Name: ZFP36 ring finger protein
  ENST ID: ENST00000600033
  CDS Start-End: 1-444
tcatatccggggaggacaagagacccaaaattgggaaacagtgagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaata

SEQ ID NO: 200803 - DNA, 1699 bp, Homo sapiens
  Payload ID: 19629
  Gene Name: ZFP36 ring finger protein
  ENST ID: ENST00000594442
  CDS Start-End: 1-1030
agcgctcccactctcggccgacacccctcatggccaaccgttacaccatggatctgactgccatctacgaggtgacctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttt

SEQ ID NO: 200804 - DNA, 690 bp, Homo sapiens
  Payload ID: 19629
  Gene Name: ZFP36 ring finger protein
  ENST ID: ENST00000594045
  CDS Start-End: 31-246
cagcgctcccactctcggccgacacccctcatggccaaccgttacaccatggatctgactgccatctacgaggtgagtccccgccgcacggcatccccggtacctgcatgcctgagtccgagtccccacctctctagcgccgcaaactccagcccgggacgcttgcctcccttctccaactggggctccctagcgccgcgccctccagcctggggcccctgcctcccgctcagaccagcttggtgatttggagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccaggg

SEQ ID NO: 200805 - DNA, 3026 bp, Homo sapiens
  Payload ID: 19630
  Gene Name: ZFP36 ring finger protein-like 1
  Uniprot ID: Q07352
  ENST ID: ENST00000336440
  CDS Start-End: 1799-2815
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggactcgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagct

SEQ ID NO: 200806 - DNA, 3190 bp, Homo sapiens
  Payload ID: 19630
  Gene Name: ZFP36 ring finger protein-like 1
  Uniprot ID: Q07352
  ENST ID: ENST00000439696
  CDS Start-End: 303-1319
gtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaa

SEQ ID NO: 200807 - DNA, 577 bp, Homo sapiens
  Payload ID: 19630
  Gene Name: ZFP36 ring finger protein-like 1
  ENST ID: ENST00000557022
  CDS Start-End: 49-577
agtgcaggtgaggcggcggccagcctggggactgcgcggggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctcc

SEQ ID NO: 200808 - DNA, 727 bp, Homo sapiens
  Payload ID: 19630
  Gene Name: ZFP36 ring finger protein-like 1
  ENST ID: ENST00000557086
  CDS Start-End: 105-727
tttcactttcccccttgcacaaaaccgaacatcccaccccaccaccacctccaagctaaaatacctgggccgcccctccccacgaagggacgcgctccaggcgaatggggagggcccggaagtcgggcctgggacagaggagccggcccaccgcctcccggtcggaagcggcagtgcagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctt

SEQ ID NO: 200809 - DNA, 3094 bp, Homo sapiens
  Payload ID: 19630
  Gene Name: ZFP36 ring finger protein-like 1
  ENST ID: ENST00000555997
  CDS Start-End: 57-266
aattgcaaaggcatcttctcagtgaagggggcggggtgggctagggctgagtggaaatggtgagagagattattgtagaaaatatctcttccgggaacttagggcaaagagttttattttcaggaatcacatccctgtctcccccaacctcagaccaggcccccaatctcctccccacaagaaaaagcaaaggcagtctgaaaacctgttgccaaaggaagggaacacttctgaaggaggaagttgagagtcttaggccagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaaca

SEQ ID NO: 200810 - DNA, 633 bp, Homo sapiens
  Payload ID: 19630
  Gene Name: ZFP36 ring finger protein-like 1
  ENST ID: ENST00000553375
  CDS Start-End: 66-633
caccaccacctccaagctaaaatacctgggccgcccctccccacgaagggacgcgctccaggcgaatggggagggcccggaagtcgggcctgggacagaggagccggcccaccgcctcccggtcggaagcggcagtgcagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgcc

SEQ ID NO: 200811 - DNA, 3696 bp, Homo sapiens
  Payload ID: 19631
  Gene Name: ZFP36 ring finger protein-like 2
  Uniprot ID: P47974
  ENST ID: ENST00000282388
  CDS Start-End: 295-1779
gccgagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaaaaaaggta

SEQ ID NO: 200812 - DNA, 1627 bp, Homo sapiens
  Payload ID: 19631
  Gene Name: ZFP36 ring finger protein-like 2
  ENST ID: ENST00000620081
  CDS Start-End: 65-1543
gccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcgctgcggctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctggggg

SEQ ID NO: 200813 - DNA, 6266 bp, Homo sapiens
  Payload ID: 19632
  Gene Name: ZFP37 zinc finger protein
  Uniprot ID: Q9Y6Q3
  ENST ID: ENST00000374227
  CDS Start-End: 29-1921
cgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagcagaaatctttttaaaagggttgttatatatgtaaaaaatgttaacaggaaaatgagagaaaataaagcagctgaggatacaaatgtgctggtagggagcgatattcaagatatattgtgaagtgtgaaaaagtaggttgctgaaccatgtatatagtatgttcccctttgtgtacaaaagggtatgtttgtttaacctctgtctcttatctctgtatgtgtatgtatctttgtatgcatatatacatgtatctgtatgtgaatagactttgaaaaaatacagaataaacttcatggtggttgccattgggcagaggagtataggactggggtctaggataggagcaagacttccttgtatatttggatttttaaatcatgcacatgtattatttttataattaaaatattttaatatgcataaatcaacattatttaaggttgtcactgagcccctccacaacatgtgagatcaacatgtgagatctcagattttgacagagttaaaatctttgtatgcttattcatgaatgatgatgaatctaaagtatatagtatgaaacttgatgttgaattcataaagactttttctatcacacacaagttctttcattaacatagtgaattataacagcactgtttctacatttgccattttttgatgttgaattgtgattgcaggtgatgatgaattgtgattgcaggtgaatgaaagtgattttatgaataatcaccctgttttatctcatattcaaagaactaacacacaaacacctcaatcagggaattcgaatgaaacaaatgtcacccctccctgttctcgctcaatattgggcattatttactggatcactgtactctttctgagtgaacccagagttggcctcagaatcattgtgcagcgtgcattccagaaggtactatgcatcaacttggactgtcacaggagacctatttgccattgcacacctggattttttttactcttgagccatagattaaaaatacttctggctgggcatggtgggtgcctgtaatctccagcactgtgggaggccaaggtgggtggatcacttgaggccaggagtttgagatcagactagccaacacaatgaaaccccatctctactaaaaatacaaaaaattatctgggcatgctgtaatccctgtaatcccagccactcaggaggctgaggcaagagagttgcttgcacccaggagatggaggttacagtgcactccagcctgggcagcagagtgaggctctgtctcaaaaaaaagaaatacaaaaaatgcacaaaacttctgaactattttgaaatctaagttgttacactaaaagcagagacataagtacagaaatggttttcaaaaacatcatacctttattttaatacaatattaatttacataatataaaatattataatttggcatgttatcttttatattttttaaagcacaatccctacattatttcatttattcctcagaactaacatatgagcagtaatcgggacttgtctagtcatgttcaatcctgttgagtaaatatttcacctagacagtaatttagcataataatgggccccaaagaaatatgtgcttaaatgccatctttacaaatatttatcattcaagctccttccttcctgacctcatttcagagaattataatgtgttaatataatatattgagaatggaatatgtgttcgtgtatgtgcatgtgcacacatgcatacacatgcacgggttgaaagctcaactcatgaatatatcccctcatttccaagtaacttatttatcacatgggaagaaaatgcaatatgaaagccatttctaccagtaatttcttaacaagtggaaatatagcactatgcacagaatgagtcatcactgtctagagctgtagaaagcctgcactttttagatggatgaaacagttgcaggttatggctatgttgaatttccacatgtcttggggaacccatagtattgccacatctgagacagtgagaattataggtatgcctgaatgatataaatgaatgctgaaagccactttgtgcagtaataaaatgaattaaaagttagcattgatgaatgaggaaaggatgtctaaatacaattggaggttagtataggaaaacagacacacagtggtaagtctgaatcgatacgtaaactctagtgtgcataaaaattgcctgaatgatttgttaaaacacagacttgagaatgcaaattcttgggcctcgtcacagacatattggatcagaaaccctgtgggtgggccttgagaatttgcattttaataagtttccagtggattcctgtgctgctggtctggggaccaccctttgagaaccactaatctaaatcatggtgtaagtaagtttaaaaaattatttttaaactgtttttcagatcctctttaagaaaatgaaggggcataaaagtaaattattattaacagttttgaaacatttatttattcaagtgatatgatcatctaagtgcctgagatacagcagtctacaaaacaaaaagaaagcaaacaaacaaaacaaaaccctgttctcatagaccttaattctagaggaggacataggtaataaataaacaactacaatataaagtataacagatcactggatggcaaaaagcaaaccaaggaaggggagggaagtgttggggaatgtaattttaaatatagtgatgggaagcaggcagtaagcttacttagatggtgacaaaagcaaagacccagagagggtaaaagagcaaaccatgtatatatatatgacggaagagcattccagggatatatcttttagaatctgagggtgtgggaagagaaagatgttaaactcctctgacataaagaagaggaaaaaaagtggaaacatttttttaaatcaagatttaaaaaaaaattacatttgtgataggtagaaaacaatctgtcacacactgcttttggtagttgtgtaagtttgtacaacctaccaaaatgtaaatctgacagtatacatcaaagccttatgatggtcggcagtccatcgaggaatctattctatgttgtacaatcaaggcgtactatgatatttattgcagaacagagagaaatagcatatacattgctagttaattgattaaataaagcatgattccttcaaaaattgagtaatatgacattaaaaaccacaatttcaaactatatttaagaagatacaaataattctttattattacttttactctcaggaatgtgtttgagtgatgcatctccaggcatcaagtgagtaatccaatattgaagaaaattaaaattttccacaaagtcccccttctagaagaatgtgctcatatcttttgaccagaaatgagtcacatgaccacacctagtttcaggtggcttgaggaaattgaatctttctttttttgttttattttgttttgagacaaagtctctgtcacccagactggagtgtgcagtagtgcaatcttggctcattacaatctctacctcccaggcttaagcactcctcccaccttagccttcctagtagctgggactacaggtgcatgccaccaagctaattttttttttttttttttggtggaaacagagttttgccatgttactcaggctggtctcaaacttctgggctcaagtgatctgcccaccttggcctcccaaagtgctgtgattaaaagtgtgagctaccacatttggccaaatctttaatttcttaaccttcatagtaaaggaaataaagagacatgggcattgaaaaatggatgttgtacaaaccaacctgtagcatctaaaatactaaataaaaaacagtttacaaaa

SEQ ID NO: 200814 - DNA, 2451 bp, Homo sapiens
  Payload ID: 19632
  Gene Name: ZFP37 zinc finger protein
  Uniprot ID: Q9Y6Q3
  ENST ID: ENST00000555206
  CDS Start-End: 72-1967
gtgcgctattaccgaagggcgccgccatcgcggctgccggacccgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcgaaggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagca

SEQ ID NO: 200815 - DNA, 1969 bp, Homo sapiens
  Payload ID: 19632
  Gene Name: ZFP37 zinc finger protein
  Uniprot ID: Q9Y6Q3
  ENST ID: ENST00000553380
  CDS Start-End: 1-1938
atgtcggtctccagcggcgtccagattctgacaaagccagagaccgtggaccggaggagaagtgcggaaacgaccaaagaggccgggcgaccactggagatggctgtgtccgagcccgaggccagcgccgcggtatcagtaacattcaaacatgtgactatggcctttacccagaaggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaattt

SEQ ID NO: 200816 - DNA, 4797 bp, Homo sapiens
  Payload ID: 19633
  Gene Name: ZFP41 zinc finger protein
  ENST ID: ENST00000330701
  CDS Start-End: 367-966
agcgggcgggcatttcctgccggtgcctagggccgacggggacgctggcactggtggggagctgttggggggtcccgcatctagggctctcctttcctgcctccggcccccgcgaggggcgcgcgcctctccccgccctccagcagtcctggtagggcccgggcgcgtccgcgctctgcagcgggaggtcctcgtcgcctctcgtctccagccagcaccaagaggatggtggcccttggcctcctggtgcagagcatcagtcccacgctgggagtgtggagaggtgcgtgggaagcaagccattgaggaagtggggccaacagagaggtcagcagccccttagccctcacgcttccaaggaacagaatgatggagaagcctgcaggcagaaaaaagaagacgccgaccccaagggaggaggcagacgtgcagaagagtgcgctcagagaggagaaggtgtccggggacagaaagccacctgagaggcccactgtgcccaggaagccccgcacagagccctgcctgagtcctgaagacgaagagcacgtctttgatgccttcgacgcttcatttaaagatgactttgagggggttcccgtgttcattccttttcagaggaagaaaccctatgagtgcagtgagtgtgggcggatctttaagcacaagacagaccacattcgccatcagagggtccacactggagagaagcccttcaagtgtgcgcagtgcgggaaggccttccggcacagctctgacgtcaccaaacaccagaggactcacacgggagagaagcccttcaaatgcggggagtgcgggaaagcctttaactgcggctccaatctcctgaaacatcagaagacgcacaccggggagaagccctacgaatgcacgcactgtgggaaagcctttgcctacagctcctgtctcatccgccatcagaaacgccaccctcggaagaagccctgagccggggccatctgcggactcgggccctgcggtgcgagcctcgccggacacctgctccgtggctccctcgtgtcccgcgtctgatgggggcgcagggccgtgcgcactgtgttccgtgccctggggacccccggaaaagcagcccagtcagatgtgggaacgtgccagcgagggagagacctttccactgcagagagtctctctgatcaagacaccgcagtgatggagaagccaccagaggctccttgcagccacagagcattttccaagttcccgatggcgaacggggctcagcaccagagaccagggagtattcactgccatccattggacgtgtttgggtcacctcagagcacccagcaggagaggctcctggtgtagtgggcagcccagcacttcccgctgctgcctgcctgtgatgtccactctgcttaagcctttcatctgccgctgaaggccccagtctggactctctgccctctgggtccccgagctctgcagcgagccctgggaccactcatccctgcccagccagcttcagtgcccggggccgcttgtccctgcccggcctctgtgccccaactgtgcttggtcctctggcttctctcctcctgctggagtgccagtccctgagctcagacccccgtccccggaactgggccacaccacgtgccctcttggcccagccttcctcccagagaggcggcctgacttacctggatggacttgggacaaaggttcctcaggaccttggacaccaccacctgctgagcttcccgtcccagccatgcagtggggcccctggggtgccctcggcagcttcggtccagcctgcatctgcccctcggccttccgacgtgggcggtgggccccagccccacagaccagcccagcattcaggctggtagagcagatcacccccaaagcaagaagttccagatgaaatatgcataagaagcagcctcaaaactaacaaaaaagattcgcacattcctcagttagaggaggagcagagatgaagaaaaggagaagaaaagcgctggaaagagaagaaaaggaacctccttctgtgcagcaggctcctggcccagggagtgcggtgtgcggcagagtgcgtgcagggaagcagcctctgaaatcgtgcagggaagcaccctgtgaaatcgtgcagggaagcaccctgtgaaatcgtgcagggaagcaccctgtgaagtcgtgcagggaagcaccctctgaaatcgtgcagggaagcaccctctgaaatcgtgcagggaagcaccctgtgaagtcgtgcagggaagcaccttctgaaatcgtgcagggaagcaccctctgaaatcgtgcagggaagcaccctctgaaatgcctagaaatagctgccgggctttcacttggttcccaaatttcttcaaaggtcaaaaccatcacagtgggcaactttacaccccagtgttcactgtcctcaggccactgcagagccatcctagtggggcagtgggcgcggggcgggggctcctgactccggtgaggtcaccctggaggggagtcccaggaatcagcctgatgttcagaatgccttcctggcatctcagaagtgtactgggggagacgtgaggacctttcagccaagtgtcagcgttcttattgcaggagaacattaaagccacaacccagaaacttctcaggagcatggcgcacccacaccagccccgggctccgcctggacagcacctcctgggccgccctgaccagcagacaccatccttccagcctctcttggccacccggaccagcgggcaccaccctcccagcctcacgcggccaccctgaccagcaggcaccatccttccagccttgctcagtcaccctgacccagagggctgccctgaccagcgggcaccatcctcccagccccactcagctgccctgaccagcgggcaccatcctcccagcctcactcggccagccgagctctgtaggcctcagagtgcagagaacctcaaatgttgtgactttgctctgctgcagggacctgccatggagtgtcccttgtgcgagcattttgagagctatgccagcatccatccctgcaggtcccatccctgagccatttctcaggagagcaggaagggagcagggagaggggtgctcccagccagccccggaaccagaggtctggggacgcagccgaccagccctccttgtctgggcctctgtttcctcttcgacacagggaagcagggaggggccgatcagcgacttaggcctgttggctgtggtggggtccacctgcgtttctggggagcccacggaccctggggtgtacctgggtttcattcccagtgacctctcctattggtccccatttggggcgctgagatgtgatcgtttctttcctgagaatgagctgaggtaaaaacatgctggggaggaagatgggccctgggggcagcgagctgcgcctctgcaccgggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggcctaacgctgctgtctcgcagtcacccctgcaggccgctcagggcagggctctggcctgacgggggttcctggacacgcctctgagccggcagcccctacccgcacccgtgcaccttccacgcccgtctccagcagcccctgcccccacccgcacccctgcacctgccacgcctgtctccggcagcccctgcccgcacccgcacccctgcacctgccacgcccgtctccggcagcacctgccacgcccgtctccggcagcacctgccacgcccgtctccggcagcacctgccacgcccgtctccggcagcccctgcccgcacccgcacccctgcacctgccacgcccgtctccggcagcccctgcctgcacccgcacccctcacggctgtctccggcagcccctgcccgcgcccgcacctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgacttgctctgcgtgagtcctcggtccacgtgggccgttgcgctggttcccagcctgcccgacacactcactgcgacgcctcccttgcctactgcttgctggcttctgtgttctctgcagtaaacattgatttctgactcga

SEQ ID NO: 200817 - DNA, 3284 bp, Homo sapiens
  Payload ID: 19633
  Gene Name: ZFP41 zinc finger protein
  ENST ID: ENST00000520584
  CDS Start-End: 1081-1680
gggggcggagtcggctggggatggagccgctcgggccgagccctccaccgcccaccatcaccgagtccggcccaggctcctagcgcggccgccggaaggggcgggtcagcgggcgggcatttcctgccggtgcctagggccgacggggacgctggcactggtggggagctgttggggggtcccgcatctagggctctcctttcctgcctccggcccccgcgaggggcgcgcgcctctccccgccctccagcagtcctggtagggcccgggcgcgtccgcgctctgcagcgggaggtcctcgtcgcctctcgtctccagccaggtactcactgggctcctgcctgccgcctccggcccaggacgcgcagcgtcggtatgggccccgccgcctccccgcaccccggcgctccagggatgtggcaagacccggctttgagcacctcccgggcgccggccccgaggccgacctagctctgcacgtgggccgcggggctctgccgttgaaaggagagcctctaactaggagcacgcacgggaccctggcgggcccctccgcctggctcagatgcctggcatctcaggccttggcacagctagcaggcccctggcaggccgtggacccagcaggctgttttagtgcagattgcccctgaatctcaagcccactaatgttccagtctctccatgagacccagatccctgaaagtagtggagggaggcgccagggtgagtgaggttttctaggcagcccttaccgcccacggatacccagagcttcatattacaagtgaagggtcctccgcccagagaggcgacggagctacgctggagttgcacgacagaaccagaaccccagtctttaggggtgtggcaagcgtgggttgcgctgtttgtaactagctaatcactcctgtctacaggcctgtgagcaccaagaggatggtggcccttggcctcctggtgcagagcatcagtcccacgctgggagtgtggagaggtgcgtgggaagcaagccattgaggaagtggggccaacagagaggtcagcagccccttagccctcacgcttccaaggaacagaatgatggagaagcctgcaggcagaaaaaagaagacgccgaccccaagggaggaggcagacgtgcagaagagtgcgctcagagaggagaaggtgtccggggacagaaagccacctgagaggcccactgtgcccaggaagccccgcacagagccctgcctgagtcctgaagacgaagagcacgtctttgatgccttcgacgcttcatttaaagatgactttgagggggttcccgtgttcattccttttcagaggaagaaaccctatgagtgcagtgagtgtgggcggatctttaagcacaagacagaccacattcgccatcagagggtccacactggagagaagcccttcaagtgtgcgcagtgcgggaaggccttccggcacagctctgacgtcaccaaacaccagaggactcacacgggagagaagcccttcaaatgcggggagtgcgggaaagcctttaactgcggctccaatctcctgaaacatcagaagacgcacaccggggagaagccctacgaatgcacgcactgtgggaaagcctttgcctacagctcctgtctcatccgccatcagaaacgccaccctcggaagaagccctgagccggggccatctgcggactcgggccctgcggtgcgagcctcgccggacacctgctccgtggctccctcgtgtcccgcgtctgatgggggcgcagggccgtgcgcactgtgttccgtgccctggggacccccggaaaagcagcccagtcagatgtgggaacgtgccagcgagggagagacctttccactgcagagagtctctctgatcaagacaccgcagtgatggagaagccaccagaggctccttgcagccacagagcattttccaagttcccgatggcgaacggggctcagcaccagagaccagggagtattcactgccatccattggacgtgtttgggtcacctcagagcacccagcaggagaggctcctggtgtagtgggcagcccagcacttcccgctgctgcctgcctgtgatgtccactctgcttaagcctttcatctgccgctgaaggccccagtctggactctctgccctctgggtccccgagctctgcagcgagccctgggaccactcatccctgcccagccagcttcagtgcccggggccgcttgtccctgcccggcctctgtgccccaactgtgcttggtcctctggcttctctcctcctgctggagtgccagtccctgagctcagacccccgtccccggaactgggccacaccacgtgccctcttggcccagccttcctcccagagaggcggcctgacttacctggatggacttgggacaaaggttcctcaggaccttggacaccaccacctgctgagcttcccgtcccagccatgcagtggggcccctggggtgccctcggcagcttcggtccagcctgcatctgcccctcggccttccgacgtgggcggtgggccccagccccacagaccagcccagcattcagggcaggacatcctggtgggccccctggcccggatctccttatgcagccgttcccggtatgtcctgaggctggacggcctcagccagctgtcaccaggagaggaatactcgcactcccagaaatggacatatcaggaggtgaattgttcagaagcaggcatcagagcacgtgtgacgtgtgatcctggatcggaagagttgctttgaaggactttgctgggacgtttggccgacctggattgtagactccaggcacagtcaactgcaggcacagtcaactgcaggcacagtcagcaccagcgcagcagggacggggcggtcctcactgacgtcctcctactgcagatgcacactgaggctcttggccgcagagcgtggcgtctgcagttcatgccaacggtgtgtgcacgtccccggagagtgacagaggagagtggctaaatgtcagtcatggggaatctagagcacaggtgggcacgcttctccgatgaagggtcaggcaggaaatattcttggcactgcagccatacagcctgtgcctcagcacccacgggggaccacagaaggttggggaccactgctttaaacaactagctctcccgtgaagagcaggtccccaccctgctgtgtagggcaacagcagatgtcaatggcatatgaatgaacgagcgtggctgtgccaataaaactttatttacaaacgta

SEQ ID NO: 200818 - DNA, 2651 bp, Homo sapiens
  Payload ID: 19634
  Gene Name: ZFP42 zinc finger protein
  Uniprot ID: Q96MM3
  ENST ID: ENST00000326866
  CDS Start-End: 409-1341
agtttctcctttgttttacgtttgggaggaggtggcattggaaatagcagagtgcttcgcggtaacaggggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaaacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaa

SEQ ID NO: 200819 - DNA, 2480 bp, Homo sapiens
  Payload ID: 19634
  Gene Name: ZFP42 zinc finger protein
  Uniprot ID: Q96MM3
  ENST ID: ENST00000509524
  CDS Start-End: 243-1175
agtttctcctttgttttacgtttgggaggaggtggcattggaaatagcagagtgcttcgcggtaacagggacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 200820 - DNA, 2338 bp, Homo sapiens
  Payload ID: 19634
  Gene Name: ZFP42 zinc finger protein
  Uniprot ID: Q96MM3
  ENST ID: ENST00000618147
  CDS Start-End: 101-1033
agcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 200821 - DNA, 1359 bp, Homo sapiens
  Payload ID: 19635
  Gene Name: ZFP57 zinc finger protein
  Uniprot ID: Q9NU63
  ENST ID: ENST00000376881
  CDS Start-End: 1-1359
atggcagctggtgagccaaggtctctcctgttcttccagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataa

SEQ ID NO: 200822 - DNA, 1980 bp, Homo sapiens
  Payload ID: 19635
  Gene Name: ZFP57 zinc finger protein
  Uniprot ID: Q9NU63
  ENST ID: ENST00000376883
  CDS Start-End: 413-1963
tccccgggagaccctgtgcccctaaatcgcggtccactgcgcgcgtcaggtttctagaagcagggtagaacagacggcagacacctagcccaggctggtgttgttactaaacaatggcagctggtgagccaagggtgaccagggccctgaactcggtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactga

SEQ ID NO: 200823 - DNA, 1980 bp, Homo sapiens; identical to SEQ ID NO: 200822
  Payload ID: 19635
  Gene Name: ZFP57 zinc finger protein
  Uniprot ID: Q9NU63
  ENST ID: ENST00000383628
  CDS Start-End: 413-1963

SEQ ID NO: 200824 - DNA, 1980 bp, Homo sapiens; identical to SEQ ID NO: 200822
  Payload ID: 19635
  Gene Name: ZFP57 zinc finger protein
  Uniprot ID: Q9NU63
  ENST ID: ENST00000446005
  CDS Start-End: 413-1963

SEQ ID NO: 200825 - DNA, 651 bp, Homo sapiens
  Payload ID: 19635
  Gene Name: ZFP57 zinc finger protein
  ENST ID: ENST00000432222
  CDS Start-End: 1-634
ggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactga

SEQ ID NO: 200826 - DNA, 1980 bp, Homo sapiens; identical to SEQ ID NO: 200822
  Payload ID: 19635
  Gene Name: ZFP57 zinc finger protein
  Uniprot ID: Q9NU63
  ENST ID: ENST00000416974
  CDS Start-End: 413-1963

SEQ ID NO: 200827 - DNA, 1980 bp, Homo sapiens; identical to SEQ ID NO: 200822
  Payload ID: 19635
  Gene Name: ZFP57 zinc finger protein
  Uniprot ID: Q9NU63
  ENST ID: ENST00000437216
  CDS Start-End: 413-1963

SEQ ID NO: 200828 - DNA, 1980 bp, Homo sapiens; identical to SEQ ID NO: 200822
  Payload ID: 19635
  Gene Name: ZFP57 zinc finger protein
  Uniprot ID: Q9NU63
  ENST ID: ENST00000448114
  CDS Start-End: 413-1963

SEQ ID NO: 200829 - DNA, 1980 bp, Homo sapiens
  Payload ID: 19635
  Gene Name: ZFP57 zinc finger protein
  Uniprot ID: Q9NU63
  ENST ID: ENST00000435906
  CDS Start-End: 413-1963
tccccgggagaccctgtgcccctaaatcgcggtccactgcgcgcgtcaggtttctagaagcagggtagaacagagggcagacacctagcccaggctggtgttgttactaaacaatggcagctggtgagccaagggtgaccagggccctgaactctgtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactga

SEQ ID NO: 200830 - DNA, 1870 bp, Homo sapiens
  Payload ID: 19635
  Gene Name: ZFP57 zinc finger protein
  Uniprot ID: Q9NU63
  ENST ID: ENST00000488757
  CDS Start-End: 152-1762
acaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaa

SEQ ID NO: 200831 - DNA, 1359 bp, Homo sapiens; identical to SEQ ID NO: 200821
  Payload ID: 19635
  Gene Name: ZFP57 zinc finger protein
  Uniprot ID: Q9NU63
  ENST ID: ENST00000548001
  CDS Start-End: 1-1359

SEQ ID NO: 200832 - DNA, 1870 bp, Homo sapiens; identical to SEQ ID NO: 200830
  Payload ID: 19635
  Gene Name: ZFP57 zinc finger protein
  Uniprot ID: Q9NU63
  ENST ID: ENST00000548574
  CDS Start-End: 152-1762

SEQ ID NO: 200833 - DNA, 1359 bp, Homo sapiens; identical to SEQ ID NO: 200821
  Payload ID: 19635
  Gene Name: ZFP57 zinc finger protein
  Uniprot ID: Q9NU63
  ENST ID: ENST00000547542
  CDS Start-End: 1-1359

SEQ ID NO: 200834 - DNA, 1870 bp, Homo sapiens; identical to SEQ ID NO: 200830
  Payload ID: 19635
  Gene Name: ZFP57 zinc finger protein
  Uniprot ID: Q9NU63
  ENST ID: ENST00000553137
  CDS Start-End: 152-1762

SEQ ID NO: 200835 - DNA, 1359 bp, Homo sapiens; identical to SEQ ID NO: 200821
  Payload ID: 19635
  Gene Name: ZFP57 zinc finger protein
  Uniprot ID: Q9NU63
  ENST ID: ENST00000549501
  CDS Start-End: 1-1359

SEQ ID NO: 200836 - DNA, 1870 bp, Homo sapiens; identical to SEQ ID NO: 200830
  Payload ID: 19635
  Gene Name: ZFP57 zinc finger protein
  Uniprot ID: Q9NU63
  ENST ID: ENST00000548769
  CDS Start-End: 152-1762

SEQ ID NO: 200837 - DNA, 1359 bp, Homo sapiens; identical to SEQ ID NO: 200821
  Payload ID: 19635
  Gene Name: ZFP57 zinc finger protein
  Uniprot ID: Q9NU63
  ENST ID: ENST00000552987
  CDS Start-End: 1-1359

SEQ ID NO: 200838 - DNA, 1870 bp, Homo sapiens; identical to SEQ ID NO: 200830
  Payload ID: 19635
  Gene Name: ZFP57 zinc finger protein
  Uniprot ID: Q9NU63
  ENST ID: ENST00000549167
  CDS Start-End: 152-1762

SEQ ID NO: 200839 - DNA, 1870 bp, Homo sapiens; identical to SEQ ID NO: 200830
  Payload ID: 19635
  Gene Name: ZFP57 zinc finger protein
  Uniprot ID: Q9NU63
  ENST ID: ENST00000548337
  CDS Start-End: 152-1762

SEQ ID NO: 200840 - DNA, 1359 bp, Homo sapiens; identical to SEQ ID NO: 200821
  Payload ID: 19635
  Gene Name: ZFP57 zinc finger protein
  Uniprot ID: Q9NU63
  ENST ID: ENST00000547911
  CDS Start-End: 1-1359

SEQ ID NO: 200841 - DNA, 1870 bp, Homo sapiens; identical to SEQ ID NO: 200830
  Payload ID: 19635
  Gene Name: ZFP57 zinc finger protein
  Uniprot ID: Q9NU63
  ENST ID: ENST00000552809
  CDS Start-End: 152-1762

SEQ ID NO: 200842 - DNA, 1359 bp, Homo sapiens; identical to SEQ ID NO: 200821
  Payload ID: 19635
  Gene Name: ZFP57 zinc finger protein
  Uniprot ID: Q9NU63
  ENST ID: ENST00000552898
  CDS Start-End: 1-1359

SEQ ID NO: 200843 - DNA, 749 bp, Homo sapiens
  Payload ID: 19636
  Gene Name: ZFP62 zinc finger protein
  ENST ID: ENST00000504225
  CDS Start-End: 269-749
ttttttttggtcggtgagtgatgatgataagctcccgctgcaggtgtgaatagagaccccggaggtgcgtcctagccctcatctggggaagcgcacctgcatacagacgggtgcaccggggaggaggcgacctgccgcgtgttcctgcaagcagaaaaggagttaactagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactgggg

SEQ ID NO: 200844 - DNA, 544 bp, Homo sapiens
  Payload ID: 19636
  Gene Name: ZFP62 zinc finger protein
  ENST ID: ENST00000506439
  CDS Start-End: 234-544
gtgcggtccgcgcttttgtcccgctggcggccgggttcccgcggcgccgccacagccagtacgttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgt

SEQ ID NO: 200845 - DNA, 3415 bp, Homo sapiens
  Payload ID: 19636
  Gene Name: ZFP62 zinc finger protein
  Uniprot ID: Q8NB50
  ENST ID: ENST00000502412
  CDS Start-End: 59-2761
cgtgcggtccgcgcttttgtcccgctggcggccgggttcccgcggcgccgccacagccatgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaa

SEQ ID NO: 200846 - DNA, 542 bp, Homo sapiens
  Payload ID: 19636
  Gene Name: ZFP62 zinc finger protein
  ENST ID: ENST00000509066
  CDS Start-End: 308-542
ccgctgcaggtgtgaatagagaccccggaggtgcgtcctagccctcatctggggaagcgcacctgcatacagacgggtgcaccggggaggaggcgacctgccgcgtgttcctgcaagcagaaaaggagttaactaggttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagag

SEQ ID NO: 200847 - DNA, 4010 bp, Homo sapiens
  Payload ID: 19636
  Gene Name: ZFP62 zinc finger protein
  Uniprot ID: Q8NB50
  ENST ID: ENST00000512132
  CDS Start-End: 230-2833
gtgcggtccgcgcttttgtcccgctggcggccgggttcccgcggcgccgccacagccagttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 200848 - DNA, 3264 bp, Homo sapiens
  Payload ID: 19637
  Gene Name: ZFP64 zinc finger protein
  Uniprot ID: Q9NPA5
  ENST ID: ENST00000216923
  CDS Start-End: 351-2396
gggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatata

SEQ ID NO: 200849 - DNA, 2876 bp, Homo sapiens
  Payload ID: 19637
  Gene Name: ZFP64 zinc finger protein
  Uniprot ID: Q9NPA5
  ENST ID: ENST00000346617
  CDS Start-End: 125-2008
cgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatata

SEQ ID NO: 200850 - DNA, 2545 bp, Homo sapiens
  Payload ID: 19637
  Gene Name: ZFP64 zinc finger protein
  Uniprot ID: Q9NTW7
  ENST ID: ENST00000361387
  CDS Start-End: 62-1999
tgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggta

SEQ ID NO: 200851 - DNA, 3040 bp, Homo sapiens
  Payload ID: 19637
  Gene Name: ZFP64 zinc finger protein
  Uniprot ID: Q9NTW7
  ENST ID: ENST00000371515
  CDS Start-End: 133-2172
ccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaagtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatata

SEQ ID NO: 200852 - DNA, 1841 bp, Homo sapiens
  Payload ID: 19637
  Gene Name: ZFP64 zinc finger protein
  Uniprot ID: Q9NTW7
  ENST ID: ENST00000371518
  CDS Start-End: 144-1391
acatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacggggtgttgctatgttgcctagatggaatgcagtggcatgatcacagctcactgcagcctcgacctcctggactcaagcaatcctcctcctcctgccccagcctcccaaatagctgggaccacaggcatgtgccaccacgcccagctaatttttttattttttatagaaacgaggtcttgctctgttgcccaggctggtctcaaactcgtgggctcaagtgattctcctgccttagccttctgaaatgctatgattacaggcacgagccaccgtgcctggcctatttttttaatatttttaaagatttgtaaaacaaagaagcatgtatggaccacaaagcctagtactacctggctctttaccaaaaaaaaaaaaaaaaaaattgccacatccaggtcagtagaacataaattatgtaaaaacttgatcactacacatttagtgattttgctgaaatcaacacaaaaaaaa

SEQ ID NO: 200853 - DNA, 2234 bp, Homo sapiens
  Payload ID: 19637
  Gene Name: ZFP64 zinc finger protein
  Uniprot ID: Q9NTW7
  ENST ID: ENST00000371523
  CDS Start-End: 408-1688
ctgcgcttctgaaattttaatgggcaaacgaatcacctggggatctcgttaaaatgcagacacggtttctcaaactttaatgtgcatgcgaatcacctggggatcttgttaaaatgcagattctgattcagcgggtctggggtagagcccgagagtctgcatttctaacgagctcccaggtggcgcgggctgcccgggagcggaccgcaagtccgcgggactcctggggtcttggctccaggccaatcagccgtcaggactcttgataaatcgccctgctcggctgatgagcagaattgccgggacatgcgcgttccggccgaaggggggtaatttccgaactccgggaattcgttgtgtgaagtaggccactcctagggacgcgcggggagcccggtcctcgcgccatgtcgcggcgcaagcaggccaagccccagcacctcaactccgaggagccgcggcctgcgcgccgggagtgtgcggaggtggccccgcaggtggcgggggagccggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggta

SEQ ID NO: 200854 - DNA, 710 bp, Homo sapiens
  Payload ID: 19637
  Gene Name: ZFP64 zinc finger protein
  ENST ID: ENST00000395979
  CDS Start-End: 27-422
aggacccctcagaggctgttttcgggatgcgcgggcacccgagtctccggcctccttggcactgggcttcggctgcgcgcctggaaggtggcttcttgccttggggttacgtttcaaatgcgttgtccagggaaggcctcaccgaggagcggacgttcgagcgaagacccgaaggatgggagggagcgagctgtgcagcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacggccagctgctgagaagagaaataagacctgctgaagcaaaggagtgccataatctatgccaggattacaaactgcagcccatgggcaactcagcctgttggcatgctccttcatttacctattgcttgcagctttctggccttacaagaggtagttgttacagggactgtagggtgcacaaagcctaaaatactatctttttgttttgtttttttctctgagacagagtcctgctctgtcacccaggctagaatgcagtggtgcaatctcagttcattgcgacccctgcctcccaggttc

SEQ ID NO: 200855 - DNA, 762 bp, Homo sapiens
  Payload ID: 19637
  Gene Name: ZFP64 zinc finger protein
  ENST ID: ENST00000395989
  CDS Start-End: 100-762
ggattcctctagccactcctctcaagagctagtcaacgagtttgcctcccaaacacgctggaaggatgctcagaggacccctcagaggctgttttcgggatgcgcgggcacccgagtctccggcctccttggcactgggcttcggctgcgcgcctggaaggtggcttcttgccttggggttacgtttcaaatgcgttgtccagggaaggcctcaccgaggagcggacgttcgagcgaagacccgaaggatgggagggagcgagctgtgcagcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctc

SEQ ID NO: 200856 - DNA, 445 bp, Homo sapiens
  Payload ID: 19637
  Gene Name: ZFP64 zinc finger protein
  ENST ID: ENST00000456175
  CDS Start-End: 1-361
agagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacggggccgggaccgggctgacctcctggagcacagccggctgcaccaggccgaccacccggagaagtgtccagagtgcagctactcctgctccagcgcggccgc

SEQ ID NO: 200857 - DNA, 2104 bp, Homo sapiens
  Payload ID: 19638
  Gene Name: ZFP69 zinc finger protein
  Uniprot ID: Q49AA0
  ENST ID: ENST00000372705
  CDS Start-End: 295-1875
gatgggaatgtggagcagaccctcgtccactccggaggccgagggtcctccgggcttccgaaggaagccgacctcaacgctggacgcttcttggagaatgattgcgttgagtggagatgtggtctgtctataaaaggccgggagggaacaatatctgttaccactcagtccgtctctaaagagacactctttaccgctgaaaacctcaagagtgagcactcccacgcccccgtctctggtcctacctgggtccaaggccgatgtgaagtggacaagtccagtaaggcaggcatcatgccacagcagctcctgatcaccctgcctaccgaggccagcacctgggtgaagctgcaacatccaaagaaggccgtggagggggcgcccctgtgggaggatgtgactaaaatgtttgaaggagaagctctgctgtctcaggatgctgaggacgtaaagacccagagagaaagtttagaggatgaagtgacccctggactcccgacagcagaatcccaggaattgttgactttcaaggacatatctattgacttcacccaggaagagtgggggcagctggctcctgctcaccagaatctataccgagaggtgatgctggagaactacagcaacttggtgtcagtgggatatcaactttccaaacctagtgtgatatcccagttagagaaaggagaagagccatggatggcagagaaagaaggcccaggagatcccagttcagacttgaagagtaaaatagaaaccattgagtcaactgcaaagagtaccatttcacaggagcgcttatatcatggcattatgatggaaagtttcatgagggatgatataatttattccacgttgagaaaagtctccacatatgatgatgtcttagaaaggcaccaggaaacttgtatgagagatgtgagacaagccatcttgacccataagaagagagtccaagaaactaacaaatttggggaaaatatcattgtgcattcaaatgttattattgaacagaggcaccataaatatgatacacctacaaagcggaacacatacaaattagatttgattaatcatccaacaagttacataagaacaaaaacctatgaatgtaatatatgtgaaaaaatcttcaaacaacctattcaccttactgaacatatgagaattcatactggtgagaaacctttcagatgtaaggaatgtggaagggcctttagtcaaagtgcatccctcagtacacaccagagaatccatactggtgagaaaccctttgaatgtgaggaatgtgggaaagccttcagacatcgctcatcacttaatcagcatcatagaactcacactggggagaaaccctatgtatgtgataaatgtcagaaagctttcagccagaacattagcttggttcaacatttgaggactcattctggagagaaaccttttacttgcaatgaatgtgggaaaacctttagacagattagacaccttagtgaacatataagaattcataccggggagaagccctatgcatgcactgcatgttgtaaaacctttagtcatagagcgtatctaacacatcaccagagaatccatactggggagagaccctacaaatgtaaagaatgtggaaaagcctttaggcagaggatacaccttagcaaccataaaactgttcatacaggagtgaaagcatatgaatgcaaccgctgtggaaaagcctataggcatgattcatcctttaaaaaacatcagagacatcacactggagaaaaaccttacgaatgtaacgaatgtggaaaagccttcagctataactcttcacttagtcgacatcatgaaatacacaggaggaacgccttccgaaataaggtgtaaaaacagatatttgacttgagaacaaaagccaagtgtaaattggtgatttagagtgctttaaaatttcaggactcagatatgaggaattgatgtaatgatgccaacttttaatttttcccattgtaaataaacattacattgacaggtattgactactaacacctctaaaaagtacttaagattaaaatctggtccttaaaattaaatgaattcagcattatgaaaaatt

SEQ ID NO: 200858 - DNA, 2871 bp, Homo sapiens
  Payload ID: 19638
  Gene Name: ZFP69 zinc finger protein
  Uniprot ID: Q49AA0
  ENST ID: ENST00000372706
  CDS Start-End: 1007-2587
gggcgcgcgctgcttcccgggagagggcgggctccgtggcagccccctgtgggcggagccggcggccggggctcacaacccgccggaagacgcgcgggttgtggcagctgcagcgggaccgcgtggggtgggccccgggaccgccagggctgcagcgagagcggccggcggtgcaagcggccgggagggcgcggccggaggcagaggccaggcgagacacccggctgcggcctaagaggccaggctgggtgggcttggctgcagccgccagccccgtgttaaagcggcagccagggaggtgtatcctccccggggtctgcaagacgccggctcagggcatccctcccattccggccctcaaagcctcgctcctgggggcgctgctgggaaagcccacccgcctgggcgggcccttgatgggaatgtggagcagaccctcgtccactccggaggccgagggtcctccgggcttccgaaggaagccgacctcaacgctggacgcttcttggagaatgattgcgttgagtggagatgtggtctgtctataaaaggccgggagggaacaatatctgttaccactcagtccgtctctaaagagacactctttaccgctgaaaacctcaagagtgagcactcccacgcccccgtctctggtcctacctgggtccaaggccgatgtgattctggagttctggagacaagtgcttctggatccctcttcccttcccttttgctcctctaaagagtatggagacatgaactcaaacctaactaactggctgcctcccaaagaaagtgcttgatttaaaggggagtttgttttccagaattgttaaagtcacatcagtctctaggaacccccaggtcctggtgctgcagggacacaccagagtcctgagggcaggtgattggaatctgagcaacaccccacaactgtgaagcgtctcatcaagagcttctggcaatttcctcaccagaagtggacaagtccagtaaggcaggcatcatgccacagcagctcctgatcaccctgcctaccgaggccagcacctgggtgaagctgcaacatccaaagaaggccgtggagggggcgcccctgtgggaggatgtgactaaaatgtttgaaggagaagctctgctgtctcaggatgctgaggacgtaaagacccagagagaaagtttagaggatgaagtgacccctggactcccgacagcagaatcccaggaattgttgactttcaaggacatatctattgacttcacccaggaagagtgggggcagctggctcctgctcaccagaatctataccgagaggtgatgctggagaactacagcaacttggtgtcagtgggatatcaactttccaaacctagtgtgatatcccagttagagaaaggagaagagccatggatggcagagaaagaaggcccaggagatcccagttcagacttgaagagtaaaatagaaaccattgagtcaactgcaaagagtaccatttcacaggagcgcttatatcatggcattatgatggaaagtttcatgagggatgatataatttattccacgttgagaaaagtctccacatatgatgatgtcttagaaaggcaccaggaaacttgtatgagagatgtgagacaagccatcttgacccataagaagagagtccaagaaactaacaaatttggggaaaatatcattgtgcattcaaatgttattattgaacagaggcaccataaatatgatacacctacaaagcggaacacatacaaattagatttgattaatcatccaacaagttacataagaacaaaaacctatgaatgtaatatatgtgaaaaaatcttcaaacaacctattcaccttactgaacatatgagaattcatactggtgagaaacctttcagatgtaaggaatgtggaagggcctttagtcaaagtgcatccctcagtacacaccagagaatccatactggtgagaaaccctttgaatgtgaggaatgtgggaaagccttcagacatcgctcatcacttaatcagcatcatagaactcacactggggagaaaccctatgtatgtgataaatgtcagaaagctttcagccagaacattagcttggttcaacatttgaggactcattctggagagaaaccttttacttgcaatgaatgtgggaaaacctttagacagattagacaccttagtgaacatataagaattcataccggggagaagccctatgcatgcactgcatgttgtaaaacctttagtcatagagcgtatctaacacatcaccagagaatccatactggggagagaccctacaaatgtaaagaatgtggaaaagcctttaggcagaggatacaccttagcaaccataaaactgttcatacaggagtgaaagcatatgaatgcaaccgctgtggaaaagcctataggcatgattcatcctttaaaaaacatcagagacatcacactggagaaaaaccttacgaatgtaacgaatgtggaaaagccttcagctataactcttcacttagtcgacatcatgaaatacacaggaggaacgccttccgaaataaggtgtaaaaacagatatttgacttgagaacaaaagccaagtgtaaattggtgatttagagtgctttaaaatttcaggactcagatatgaggaattgatgtaatgatgccaacttttaatttttcccattgtaaataaacattacattgacaggtattgactactaacacctctaaaaagtacttaagattaaaatctggtccttaaaattaaatgaattcagcattatgaaaaattcataacagtttttttctgatttcatggtggattaataaattattcttcatgggta

SEQ ID NO: 200859 - DNA, 2029 bp, Homo sapiens
  Payload ID: 19639
  Gene Name: ZFP69 zinc finger protein B
  Uniprot ID: Q9UJL9
  ENST ID: ENST00000361584
  CDS Start-End: 298-1902
gggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcac

SEQ ID NO: 200860 - DNA, 2109 bp, Homo sapiens
  Payload ID: 19639
  Gene Name: ZFP69 zinc finger protein B
  Uniprot ID: Q9UJL9
  ENST ID: ENST00000411995
  CDS Start-End: 376-1980
ggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcacaa

SEQ ID NO: 200861 - DNA, 1976 bp, Homo sapiens
  Payload ID: 19639
  Gene Name: ZFP69 zinc finger protein B
  ENST ID: ENST00000484445
  CDS Start-End: 367-762
ggccgcgcagtgccggaacccggctgcagcggtgggaaggcgggggcgtgccggcccagcggggagagggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatt

SEQ ID NO: 200862 - DNA, 2623 bp, Homo sapiens
  Payload ID: 19640
  Gene Name: ZFP82 zinc finger protein
  Uniprot ID: Q8N141
  ENST ID: ENST00000392161
  CDS Start-End: 244-1842
gcgcagcccgttaggccccggggattgtggcgtgacccggcagcggcttcctccgttcgggcatcgctgtgcctcgggttcgcgccccgagtgagcagtcctggcccggagcgtcggtcctggtaatctgtaggaaaagcgctgcggcccagggggtaaagagagatcagcctctgtggactcggtgcttctcctggcaagtaaaccccaaggaggactgaccagttcttgaatttctataccatggcccttcgatcagtgatgttcagtgatgtatccatagacttctctccagaagagtgggaatacctggacttggaacaaaaggacttgtacagagatgtcatgttggagaactacagcaacttggtctcactgggatgcttcatttctaaaccagatgtgatttcctcattggagcaaggaaaagagccttggaaagttgtgaggaaaggaagaagacaatatccagatttggagaccaagtatgagaccaagaagttatctttagaaaatgacatttatgaaataaatttatcccagtggaagataatggaaagaattgaaaaccatggccttaagggtctcattttaaaaaatgattgggaatccacaggaaaaattgaaggacaggagagacctcaagaaggatacttcagtagtgtgaaaatgccatctgaaaaggtgtcctcttaccagaaacgcacatctgttactccacatcagagacttcattttgttgataaaccctatgaatgtaaggaatgtgggaaggcgttcagagtgcgccaacagcttacttttcatcacagaattcatactggtgaaaaaccgtatgaatgtaaggaatgtgggatggccttcagacagactgcacaccttactcgacatcagagacttcattctggtgaaaaactctatgaatgtaaggaatgtggggaagctttcatatgtggtgcagatcttagagtacatcagaaaatgcatattggtgagaagccctatgaatgtaaagaatgtgggaaggcttttagggtacgaggacaacttactctgcatcagaggattcatactggtgagaaaccctatgtgtgtaaagagtgtggaaaagcctttagacagtacgcacacctgactcggcatcagaagcttaatagtgctgacaggctctatgaatgcaaagaatgtgggaaggcctttttgtgtggctctggtcttagagtacatcacaaacttcatactggtgagaaaccctatgaatgtaaggaatgcgggaaggcctttagagtgcgacaacaactaacactccatcagagaattcatactggtgagaaaccctatgaatgtaaggaatgtggaaagacctttagccgtggttatcatcttattctccatcacagaattcatactggtgaaaaaccttacgaatgtaaggaatgctggaaagcctttagtcgctactcacaacttatttcacatcagagtattcatattggtgttaagccctatgactgtaaggaatgcgggaaggccttcagactactttcacaactcacacagcatcagagtattcatattggtgagaaaccttataaatgtaaggaatgtggcaaggcctttagattgcgccaaaaacttactctacatcagagcattcatactggcgaaaaaccctttgagtgtaaggaatgtaggaaggcctttagacttaattcatcccttattcaacatctgagaattcattctggtgagaaaccctatgaatgtaaggaatgtaagaaggcctttaggcaacattcacaccttactcatcatctgaaaattcataatgtaaaaatctaagaaagtcttttcaacttctgtgttatagaacattctatgaatgtagtaattaatctattttgctccatacatgcaactgcgttggcattagaggttttataccattaaaagagtgtgacaatgtattgtagtccatcatcactcaaacctgaaacttcagcatatttgttctaaaaactaatcctgttataagaatgaaaaagacatttaccgtcatccctatcccatcactttgtgtcatactggacaagacgcttaactgctctgtgctataattttttaatttatgacatggtcatataagagtgcagcagtttgacacactttcaatcaagaggtggaatctacatccctctgttgtatacaggaatctacatccctctgtgactgcttcgcccagtagaatatggtagacgtactgctgtgctggtttcttgactcagactttactggtagggttacttcatctcatgaaatgacagaactgtcttgttacaaagtctggctactttgctgaagagaccacatgaagaggccctgaaactacgtagagagggagaggcacctgctgaaccctgtcttcttgacatccaccaagataccagacatttgagtgaaattttggatccaccagaccagccaccagctaaatgccagtgagcgacttggtaacctgaactgatgccatgtagaatggaagaattgaccagctgagcccctggcccaaatttctgacccacaaaaacatgagatataataaaatggttgttgttttaagcca

SEQ ID NO: 200863 - DNA, 1360 bp, Homo sapiens
  Payload ID: 19640
  Gene Name: ZFP82 zinc finger protein
  ENST ID: ENST00000445543
  CDS Start-End: 1-148
agagccttggaaagttgtgaggaaaggaagaagacaatatccagatgctgcgataaccaaaaggacttcgaagatgaaaatgtcagcattatggcagatgtatgattactggtatggtgaggaaagcaactcccatcatgctttgtaaccagctgcttgctttttttgaatgatacttttcaatagaatagaaagcccactagtcctatcttttatatatacattatatgtatttaaactttcttattgatcaatatttaggtgataagcattttctcactgtgaaaaataccttattgaataggtctgtgtttattactgtacataagcaagagtttctctaaggtatttatcaaaagtaggattgctcagtcatagttaatatttactttcaacctcactagatactgtcatagaagtagagagcatcagtatgctcccagtgcacaatcccttcaaccagtgaaatatgttttccttatttccttatatccttacttctggtatgcatagtaatattttcctggttaatagtgaattgggcatattttcacatctgaatattggctaaacgctgtaacttgccaatttatgtctttgcctgtgttcctttaaaaaagcttttaaaatataagaattataagattcttaaaaaataaaattctagatagtagtcctttgttataaatggacttaccttctcccatattgtatttatgttgatattgtcatatgaatacgttaaatgtggatacaatcatagctttcattattacctaataatcttttaaattttattttttactagactcttggttttctaggcaatcaggtgtgtcaactgcaaatagatataattttgtttttttctaaatatagtgattattttttaaattattgttattgtaatagagtctccaaaacaaggtttagtattcatggtgataccaggcatctggtcattttctccaatttaatgaaaattacttggtgtaatgtttactctaggtctgagataaatagattttgtagctcagttgtctcagttcttgtttaacttttttttttattagaaatatctgctaaatatagtcagatgcctttttggctcattgatatgatgtttttctccttgagtttgttaatgtgacaagttgtactgtagtcattaaggcaggtatgttagaatgaaccagaatgttcgatgagcaagaatgaacaaatagaccaatggaacaaaataaagagccctgaagtagatctctctctctatatatatgtggttgtctaatttgtgataaagtttcctcggccatgtggttgggaaatggtggtcttttcaataaaaagcactggatca

SEQ ID NO: 200864 - DNA, 4384 bp, Homo sapiens
  Payload ID: 19641
  Gene Name: ZFP90 zinc finger protein
  Uniprot ID: Q8TF47
  ENST ID: ENST00000398253
  CDS Start-End: 36-1946
ctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatttggttacacaactgaacattcctgcaagaataaggcctagtgaatgtgagacccttggaagcaatttgggacataatgcagacttacttaatgagaataatattcttgcaaaaaagaaaccctataagtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagattttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaagcaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagttaagtctaattgcccattgccataaattttgccttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcagcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaatggga

SEQ ID NO: 200865 - DNA, 556 bp, Homo sapiens
  Payload ID: 19641
  Gene Name: ZFP90 zinc finger protein
  ENST ID: ENST00000569323
  CDS Start-End: 91-273
gcggggtggggtcggtgttgcagcggggtgagtgggccctgtcctttctccccagctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttgagttcctgaggatcaaggactagtactgacttgtccttaggagggttctttgtccacttgcacaaacaaccaaatcttgtgtatttacccatgagcaggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgt

SEQ ID NO: 200866 - DNA, 2512 bp, Homo sapiens
  Payload ID: 19641
  Gene Name: ZFP90 zinc finger protein
  Uniprot ID: Q8TF47
  ENST ID: ENST00000563169
  CDS Start-End: 232-2142
caggcgcacttccagttctgccccaccgctgcggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcggtgattctgactcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatttggttacacaactgaacattcctgcaagaataaggcctagtgaatgtgagacccttggaagcaatttgggacataatgcagacttacttaatgagaataatattcttgcaaaaaagaaaccctataagtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagattttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaagcaaattcctgcagtaatgaccaaaacccatttt

SEQ ID NO: 200867 - DNA, 4664 bp, Homo sapiens
  Payload ID: 19641
  Gene Name: ZFP90 zinc finger protein
  ENST ID: ENST00000564558
  CDS Start-End: 219-401
agttctgccccaccgctgcggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcggtgattctgactcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttgagttcctgaggatcaaggactagtactgacttgtccttaggagggttctttgtccacttgcacaaacaaccaaatcttgtgtatttacccatgagcaggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatttggttacacaactgaacattcctgcaagaataaggcctagtgaatgtgagacccttggaagcaatttgggacataatgcagacttacttaatgagaataatattcttgcaaaaaagaaaccctataagtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagattttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaagcaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagttaagtctaattgcccattgccataaattttgccttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcagcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaatggg

SEQ ID NO: 200868 - DNA, 485 bp, Homo sapiens
  Payload ID: 19641
  Gene Name: ZFP90 zinc finger protein
  ENST ID: ENST00000562156
  CDS Start-End: 175-485
acttccagttctgccccaccgctgcggccattgtccgaccccggtgcggctgaggcccctttgggcagcccctccgcagatcagaattggagataaccgaggcttcggcgggggcgggaggagctgcccgaggctctggctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcaga

SEQ ID NO: 200869 - DNA, 648 bp, Homo sapiens
  Payload ID: 19641
  Gene Name: ZFP90 zinc finger protein
  ENST ID: ENST00000576805
  CDS Start-End: 201-383
gtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcggtgattctgagtgcgcggctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttgagttcctgaggatcaaggactagtactgacttgtccttaggagggttctttgtccacttgcacaaacaaccaaatcttgtgtatttacccatgagcaggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacatt

SEQ ID NO: 200870 - DNA, 538 bp, Homo sapiens
  Payload ID: 19641
  Gene Name: ZFP90 zinc finger protein
  ENST ID: ENST00000569109
  CDS Start-End: 439-538
acgcccccgccctccccttccagcccgtggctcggcgacttacagggagggagaacatggctgctggcttttagcacctggtgggtttcgcgccttgcaactcgacaactgccgggacggagtctggctgcgcgaccccctgcggcaggtgctgggcgaggcgcctcccctgcaactagcctgccgcttccctcccggcacccccgccgccagccccgagcgcggacctggagcggagaagagagagtcttgctctgttgcccaggccggagtgcaatggtgcaatgtcagcttactgcaacctccacctcccaggttcaagccatcctcctgcctcagcctcctgagtagctgggagccatcacgcccagctagccatcttctaattttcattccttcaaagctcctgccccggagccgggccctggcgaggcaggaatggccccgaggcctccgaccgccgcgccccaggaagaatggtaccatgtcgaccctgctcagaggagcttatacagggatgtgatgctggagaactata

SEQ ID NO: 200871 - DNA, 505 bp, Homo sapiens
  Payload ID: 19641
  Gene Name: ZFP90 zinc finger protein
  ENST ID: ENST00000573113
  CDS Start-End: 1-309
gaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccaggatttgtctgcctcctgccgctgtcgctaccatctgggagtaagggcgaaagaagacagaaacttccaagaaagaatcctgagtgatgtcagcaagaatggctaagtaaggacctccagaagttctctgccccgtacaagccatgcaaatactgacaaaactgtgagaatcagatttttcacaactctggaacatttattccagcaagcagcaaatgttccccttgcagcaagctaggaaacatttatttaaaaaaaaaaaaaaaaagcatttcattaacaa

SEQ ID NO: 200872 - DNA, 717 bp, Homo sapiens
  Payload ID: 19641
  Gene Name: ZFP90 zinc finger protein
  ENST ID: ENST00000571382
  CDS Start-End: 581-717
ggctgctggcttttagcacctggtgggtttcgcgccttgcaactcgacaactgccgggacggagtctggctgcgcgaccccctgcggcaggtgctgggcgaggcgcctcccctgcaactagcctgccgcttccctcccggcacccccgccgccagccccgagcgcggacctggagcggagaagagaggtcggtgcctccaacccggggccgcggtcgaggggcgcgcgtcgttgctctgggactcactgtcgaccaacccccattcctcaggggctcggctccttccccaaggctcaggacgtagagcttgggcggggccccctgcccagcagcagtcagcggagctgcacgagtcagactccacttctggtgcacctggtaccttgagtcttgctctgttgcccaggccggagtgcaatggtgcaatgtcagcttactgcaacctccacctcccaggttcaagccatcctcctgcctcagcctcctgagtagctgggagccatcacgcccagctagccatcttctaattttcattccttcaaagctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaa

SEQ ID NO: 200873 - DNA, 199 bp, Homo sapiens
  Payload ID: 19641
  Gene Name: ZFP90 zinc finger protein
  ENST ID: ENST00000573161
  CDS Start-End: 1-159
ggccccgaggcctccgaccgccgcgccccaggtggcacttacctcttaggacctggtacagagcctaccttgaagtgttctctccctctcccaatcttttgtgctttgagcgcctgcagcacctcaccttactgtgtattgtctcatattgtgctctaataaataacgcttttaaaataaactgaaccgtattcaagga

SEQ ID NO: 200874 - DNA, 543 bp, Homo sapiens
  Payload ID: 19641
  Gene Name: ZFP90 zinc finger protein
  ENST ID: ENST00000573685
  CDS Start-End: 233-543
acttccagttctgccccaccgctgcggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcggtgattctgagtgcgcggctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcaga

SEQ ID NO: 200875 - DNA, 4636 bp, Homo sapiens
  Payload ID: 19641
  Gene Name: ZFP90 zinc finger protein
  Uniprot ID: Q8TF47
  ENST ID: ENST00000570495
  CDS Start-End: 293-2203
cgggcctctgggaagtgtagttcgcgcgcccggcgtggacccggggttgcaggagcgaggctccgagtgcgcaggcgcacttccagttctgccccaccgctgcggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcgctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatttggttacacaactgaacattcctgcaagaataaggcctagtgaatgtgagacccttggaagcaatttgggacataatgcagacttacttaatgagaataatattcttgcaaaaaagaaaccctataagtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagattttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaagcaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagttaagtctaattgcccattgccataaattttgccttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcagcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaa

SEQ ID NO: 200876 - DNA, 579 bp, Homo sapiens
  Payload ID: 19641
  Gene Name: ZFP90 zinc finger protein
  ENST ID: ENST00000576305
  CDS Start-End: 439-579
acgcccccgccctccccttccagcccgtggctcggcgacttacagggagggagaacatggctgctggcttttagcacctggtgggtttcgcgccttgcaactcgacaactgccgggacggagtctggctgcgcgaccccctgcggcaggtgctgggcgaggcgcctcccctgcaactagcctgccgcttccctcccggcacccccgccgccagccccgagcgcggacctggagcggagaagagagagtcttgctctgttgcccaggccggagtgcaatggtgcaatgtcagcttactgcaacctccacctcccaggttcaagccatcctcctgcctcagcctcctgagtagctgggagccatcacgcccagctagccatcttctaattttcattccttcaaagctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactat

SEQ ID NO: 200877 - DNA, 650 bp, Homo sapiens
  Payload ID: 19641
  Gene Name: ZFP90 zinc finger protein
  ENST ID: ENST00000571809
  CDS Start-End: 152-334
gcggccattgtccgaccccggtgcggctgaggcccctttgggcagcccctccgcagatcagaattggagataaccgaggcttcggcgggggcgggaggagctgcccgaggctctggctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttgagttcctgaggatcaaggactagtactgacttgtccttaggagggttctttgtccacttgcacaaacaaccaaatcttgtgtatttacccatgagcaggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactg

SEQ ID NO: 200878 - DNA, 560 bp, Homo sapiens
  Payload ID: 19641
  Gene Name: ZFP90 zinc finger protein
  ENST ID: ENST00000564323
  CDS Start-End: 215-496
acttccagttctgccccaccgctgcggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcgctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagcagtgtatttcaacaggaaggaataggggacttttgtactttggatttctttcagactggaagaccaggcctgaagtcaaatcatcacat

SEQ ID NO: 200879 - DNA, 695 bp, Homo sapiens
  Payload ID: 19641
  Gene Name: ZFP90 zinc finger protein
  Uniprot ID: Q8TF47
  ENST ID: ENST00000611381
  CDS Start-End: 190-531
ggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcgctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccaggatttgtctgcctcctgccgctgtcgctaccatctgggagtaagggcgaaagaagacagaaacttccaagaaagaatcctgagtgatgtcagcaagaatggctaagtaaggacctccagaagttctctgccccgtacaagccatgcaaatactgacaaaactgtgagaatcagatttttcacaactctggaacatttattccagcaagcagcaaatgttccccttgcagcaagctaggaaacatttattt

SEQ ID NO: 200880 - DNA, 5220 bp, Homo sapiens
  Payload ID: 19642
  Gene Name: ZFP91 zinc finger protein
  Uniprot ID: Q96JP5
  ENST ID: ENST00000316059
  CDS Start-End: 172-1884
ggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatggaa

SEQ ID NO: 200881 - DNA, 2319 bp, Homo sapiens
  Payload ID: 19643
  Gene Name: ZFP91-CNTF readthrough (NMD candidate)
  ENST ID: ENST00000389919
  CDS Start-End: 111-1700
gagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacggagcattcaccgctgacccctcaccgtcgggacctctgtagccgctctatctggctagcaaggaagattcgttcagacctgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtagcagttagtcccttctctcttccttgctttctcttctaatggaat

SEQ ID NO: 200882 - DNA, 1788 bp, Homo sapiens
  Payload ID: 19643
  Gene Name: ZFP91-CNTF readthrough (NMD candidate)
  ENST ID: ENST00000422974
  CDS Start-End: 1-1065
aagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacggttgagttaagggatggctttcacagagcattcaccgctgacccctcaccgtcgggacctctgtagccgctctatctggctagcaaggaagattcgttcagacctgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtagcagttagtcccttctctcttccttgctttctcttctaatggaatatgcgtagttccctggggcctcgctttcccatcttaaatttctaaaaacagttaagacaacaggcattttctt

SEQ ID NO: 200883 - DNA, 6105 bp, Homo sapiens
  Payload ID: 19644
  Gene Name: ZFP92 zinc finger protein
  Uniprot ID: A6NM28
  ENST ID: ENST00000338647
  CDS Start-End: 2-1252
gatggcagccattctcctgaccacgagacccaaggtgccagtatcttttgaggatgtgtccgtgtacttcacaaagacagaatggaagcttctggacctcagacaaaaggtcctctacaagcgggtgatgctggagaactatagccatttggtgtcactgggattttccttctccaagcctcacctgatctcccaattggaacgaggggaaggaccctgggtagcagacatccccagaacctgggccaccgcaggattgcacataggtgacagaacacagagcaagacgtcgacttcaacgcagaagcattctggacgacaactccccggggccgatccacaaggtggcaaggaggggcaggcggcgaggtcgtctgtgctccagagaggtgcccagggcttggggcagagttcggctgcggggccgcagggccccaaaggcgcggagaagcggtacctgtgccagcagtgtgggaaggccttcagccgcagctccaacctcatcaagcaccgcatcatccacagtggcgagaagccttacgcgtgccccgagtgcggcaagctgtttcgccgcagcttcgcgctcctggagcaccagcgcatccacagcggcgagaagccctacgcctgccccgagtgcagcaagaccttcacgcgcagctccaacctcatcaagcaccaggtcatccacagcggcgagcggcccttcgcctgcggcgactgcggcaaactgttccgccgcagcttcgcgctcctggagcacgcgcgcgtgcacagcggcgagcggccctacgcgtgcccagagtgcggcaaggccttcagccgcagctccaacctcatcgagcaccagcgcacgcaccgcggcgagaagccctacgcctgcggccagtgcgccaaggccttcaagggcgtctcgcagctcatccaccaccagcgcagccacagcggcgagcggcccttcgcgtgccgcgagtgcggcaaggccttccgtggccgttcgggcctcagccagcaccggcgcgtgcacagcggtgagaagccctacgagtgcagcgactgcggcaaggccttcggccggcgcgccaacctattcaagcaccaggcagtgcacggcgccaggcgccctgcgaaggcggagacggcgcggaggctagcgggccctgggagcaccggccctgggagcgcggtggcggccaccagccccccgcggccgagcacagccgccaggccttccaggcccagccgccgctgactccccgccagcgcacccagggcgcggccggtctgcgtggggggccttcctggggacgtcgaggctcagcccccttcaggtgggaagaccgccctcccagggcctcgattgcggccacagccctgacctctttggccatcagaagaccccaggcagagcctcaccctgaggctgagaaacgcaggaaggactcagaaccgaggactgccgcctgccctggctcctccatcaacggcagtgcgggctgggaatggaggccctctactccctcctgagtcctgggccttgcaactgaggcacatagatggcacctgggccactcgtccctgagccacaggtactatcgagtgtgcacaggcgtgcgtggaggggatgcgtgaaccatccctcggatttgcatcagaatcgcctgctgcgggtagggaggaggccacgtgaggccagtgaggccagccagcgcggggcacgctggctttgagttacagaagagtggtgcatttcctccctgggggtcgttcccctcgccctaagagttgttagtgttcccaagtagaagatactgaaagcactttaatcctttaagcgcttatattgcaggtgggggaggcgctaaagttagcacagaggcaagaggctccctgaatgttggcataggatggggggctgtgccagaaaactcccgccttgtctgggtggccccagctgcttctgggaggaggagcagcgcccaggccccatcatccctgagcaccagtggttctgggaatggctagcccaggccctgcagagaggataagacccttcaagtcactcacaattggacatttgtagctagccaccctccaggctttgctttcccccctgcccgcccactgccttctgctccccagaccccaccagcaaaggccaccctggcctctctgtcccctgtccccctgccccgccccaccaccagtgcctaaagcttcgcacttacctgctcctccccatcaggcagcctctcttgcggctggtgacgattaggaggaaagccagacgggttaggaatttgcacttaggcaacagagcaagcccaggaacgaatctttcatcgaatgtcttttgcgtgacattttgtagaatactggacgttccgttgctttgattgtttttgtattcaggggtaatgtatattgaaaatagagattttgccatatcagagtatcagggattcactccctaaataagagtccccccagccctctgagaagacctcaggcaggagaaagggggccaccccaggcctgcccccagatgagtgtggtggcaagcctggcccctcttctccctacaacgatgcagtccacccctcttccccttagccctgcagaaacagggcagactcttcaaatggcactttactgaaagccaaggggaattctcaaggaaaagtctcagggctggcagaggcagctgctggcaggccttatcctagttccccagcgctgtccccagagctgggctcaggagctctgccccttggtgctctcagcccagcgtcctggtcagcggccacctccttccagccctgtcccctcccaggggagagggggtttttcatccacaaggcctgagggcaggtgggtggtaggcgtggtggaggggggaggttcaaagacagctggctcctatcaggagagtgtgggaagacccaaacatacaggattccctcggagaatgctgcttggagtgccagtcactaggacaactccagaaataatgttatacacacacacacacacacacacacacacacacacacacacgatatatatagttttatgaaaacttctagagttcttgtaagttgcacttataccgtagcctccttcagtgtgtccctattccccatcctgtgattgcgttcttgtctgcaagctggtctcataagcccacaagtgtgtgtcatgcctgtccccatgtccttgatgccaagcccggtgctggtaatcagtaagcatgagtgaaataggtcttgcagtcctagcacctcagactcaggcttgggaccattgtcggctccagccttgccttgaggcaatccgaagcatctacgactttgggttttccagaaaaagaagtattaggaatggtgtatttgaagtccctgatgaggccattgggaagtctgggtttttctgctgtgcagacagtctttgcaagggctggcatgggcccagaaatgcaatcctcgtgcagagtaggtgcctgtggcaggaggccatgcaattgggctctagtcttgcttcattcaactgaaccaggaaagaaacagatccacgcactctgatacccatttccgttgttctaggaggtaaatgatttcgttcctacaagccagacagtagccagctttcactaaagaagaatcgactccttagtatcttgtcatgccattggttctgatgcataagtgaaccctgtttttaacggaagctccttttttttcacctcaggacctacccaagactgtctagatactggcaggacaaggtacaggagttttcagcagaaagtggagttgccaggagagatgctgggcacttgcactgtgactttggagtgccgggaaaagttccagggtccccagtgcttacttagataaatggcatttaaaatagtgcagccttttatcattgcttagtctaatttagctccccataatgacattctcactgcaaggtggtcattgctatcattttcttttgggtgtggcagttaggtatgccacgtgagctgaacgggtttcacatggaatcaaagtcagaatgttcgaaaaggacatttgtgtttttccttcaatggtgccttgaaattgggctccctccctcttgctgtgtggggaactgggagggtatagcccaagcttgctttgtgatggacagctagaatgtaaaagcttaaactatggggaaagtcttgcctgttttccaaggcttcctccaccctgccaccgaagaacttacctggatgccaacctgggacccctttgtctttgggcttttgccctttgaaactgtgaatgcttcaagagccacataaatgctctggcagtgtctccatgtaactagtaaattgtcctggctggattcgttgtgaaatggaactgtcccatttactttggttgcaaataaggaagatgtatgagtattggcctggaaatgagccctctagtgtagagaggttattctgagggtttaaactacatggataggccttgggttcaaggttacaggaaaggctgtaagcctgagattgtggggaatggccagagctgggctttgggtgttccttgtgggggtccctgtgaaggtaagacagaaaggcattctgggtgagctgcctcgggtcagcccaggggtgcaggctcctctgactgggaccacaggcagccacccgaggccactcagatgccgtgactctgagaccagagggaagggaggctgggcctggtcccctgtgttcctcagcaaagtgccacatcagtctcctgagaacacagctgtgtgttctttccagtcgcttctgttcccagacttcaggcaacatggcagctcccatacttgccagggtagttggaagggcagctctggagacaggaagtggaggtagaagcaaaggaagggagtccttggctgggaagtgcttgggttcggacagacagggaagaagggaaagtatgaggtgtgttcagggaagcttagaagggcagagaggtttcagtaggacatgtatgggctaaagggtcagttagaaccagagtatggagagtctgggatgccatatacaaaagtttgggctctaacagtctcctgatgaggagcaattttccaaaacatgaaagaattattctaagaatgacaaagggaagttaatataaattatgactaccacagggtttgaatttacacactgaccaccacaaattttataactgtagtcgtctcgatggttgtgatgcccatgaggtgttgggctgggggcatgatgacgctgaggcaacatgagaggggacgtctttgacaccagggccccagccacgtgtctcaggggctcccacttgccatgggactcgcagctggttccatccgatgccagccccagtgcatctatcactgtcttcacaaaacgggggtcctccaggagttctggacagctgctctgcagattcttatatacctttaatcgaaggccttggacttttgagaggagcgcagtgccctccttttgtgttcaggaaggccaaattagagccttctccaccgccggggaatattcatgtgggaaatggaggcctgctgcagacctgaaggtcaatgattgtttaatctttctttgacagcattatgaaggtataatgggcatacaagaaactgcacgtctttaaagtgtacagttggagggtttttggcatgtgtggacacccatgaaacctcccccataatcaagacagtgaattgatccgccactcccaaaagtggccttgcgcctccagcaacccctctttcctgctcctcactgtcccccatccccaccgccactgcttggcttgctgtcactatagattaattcccattttctagaattccatagaaatggactcatacagtgtatgtctggcctctttcactcagcacaattcttttttcatcaggtgtttttgtgcatatcagtactccatttttttttattgttggtaggatcccattgtatgggtggaccacaatacctgttgaatacctgttgatggacatttgggttgttaccaggttttggccatgacaaataaagctgctgtgaacatttgtgtacca

SEQ ID NO: 200884 - DNA, 1257 bp, Homo sapiens
  Payload ID: 19645
  Gene Name: ZHX1-C8orf76 readthrough
  Uniprot ID: Q96EF9
  ENST ID: ENST00000357082
  CDS Start-End: 95-973
ggagaagacagactgctgctttggacctgttggtaatgatggcctgagctaaacatctaactagaagggatacccttccatttcaaagaacagaatgctaaggaagctgtggcaatggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgcttaca

SEQ ID NO: 200885 - DNA, 581 bp, Homo sapiens
  Payload ID: 19645
  Gene Name: ZHX1-C8orf76 readthrough
  Uniprot ID: Q96EF9
  ENST ID: ENST00000622816
  CDS Start-End: 162-581
aaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaatggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagag

SEQ ID NO: 200886 - DNA, 5241 bp, Homo sapiens
  Payload ID: 19646
  Gene Name: Zic family member 1
  Uniprot ID: Q15915
  ENST ID: ENST00000282928
  CDS Start-End: 730-2073
atgattgctgctatcagtctcgcgctcaccgcccggctgaggaggtgaaagtttctccccaggaagataaaccgcaaaagacaatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggagaagtaaggaggggcgcgctgcgcgaggcggagagagggcgaagcagtcgcggcactggcgctcacattcctctatgctacaaatccaggaggaagtttttttttagggggctgagatgctccatgcctttccccgggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctccgtgattgtggtaggaatttcttcttcacccaccagcaacctgctgcctcttctgccagtcttaaagggtctccagaaaagctctccagtctcccttgccttccctttctgtcactgcaggtcgtataaacgtgataaatgaatgctaccctgctggctctccgagagagtgtaattagtatttatatcaaaatttatgaaacaaattttcggccgcagtataatttaaatgacctttgcagatgtagaataacaaccataaaaataacaggaatagattgcacaggcgacatcaatattaatgtagacgaattgtcagaagctcaggggctcgctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtaatttgattatctttctatctcttttatttatttctcatttacttaagaaattcgttccattggttggcattgatacagtaaatttgtaaatgaggagacaatataaaaaatctaaattacttgtgcttaatgactgtagcagaatgccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggctgtagttgctagtgtgtggaggtgcagagcaggtggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgtttcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctcttctctctagaaaagataacaccacaattaataatccttcccactttcattgagatcagcttgtctgataacctgatatgagtgtgataatgataaacatgataatagtggtacttttgtaattttgctggtgcatttaagaagatagtaaatgatgagttcatcttttcttcgaacattcctattcctagatgtagtttacctcaaattgggaattataactgtctaatttttgttgtgtacctgatgccccttttgctttaataccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaa

SEQ ID NO: 200887 - DNA, 539 bp, Homo sapiens
  Payload ID: 19646
  Gene Name: Zic family member 1
  ENST ID: ENST00000488404
  CDS Start-End: 1-410
atcctttcggtgcggacagtcgccttcaaagccaggccccggattcaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaa

SEQ ID NO: 200888 - DNA, 2983 bp, Homo sapiens
  Payload ID: 19647
  Gene Name: Zic family member 2
  Uniprot ID: O95409
  ENST ID: ENST00000376335
  CDS Start-End: 294-1892
ccgcctggctttggactcttctcctcctccacctcctcctcctcctcccgcgccgccgcctcctcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 200889 - DNA, 1596 bp, Homo sapiens
  Payload ID: 19647
  Gene Name: Zic family member 2
  ENST ID: ENST00000620342
  CDS Start-End: 1-1596
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagcgcggcttcggggactgcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtga

SEQ ID NO: 200890 - DNA, 3469 bp, Homo sapiens
  Payload ID: 19648
  Gene Name: Zic family member 3
  Uniprot ID: O60481
  ENST ID: ENST00000287538
  CDS Start-End: 551-1954
ttactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgc

SEQ ID NO: 200891 - DNA, 1968 bp, Homo sapiens
  Payload ID: 19648
  Gene Name: Zic family member 3
  Uniprot ID: O60481
  ENST ID: ENST00000370606
  CDS Start-End: 175-1548
gcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaagtgttgtcctgcttggtatccgggacagtctctaattcctgacgaagaacttgatactgacgttggtatgcagcagccagccctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaatta

SEQ ID NO: 200892 - DNA, 4331 bp, Homo sapiens
  Payload ID: 19649
  Gene Name: Zic family member 4
  Uniprot ID: Q8N9L1
  ENST ID: ENST00000383075
  CDS Start-End: 514-1518
acacaacaagggaggggacctaaggggggaagggtagctgttgggagggggagagggaaaataattcttcaaaaaagaaaagtcagtcttctcctctccagtccgtggaaaatccaacggggacgttgacaagagggtatttttaggaaacacatccaaatatacagggtaagagtgaatgtgagaaaaaaaaaagttgtgggttgtagaagttatcaagtgggatttgcggcgctctctgcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttgaa

SEQ ID NO: 200893 - DNA, 3979 bp, Homo sapiens
  Payload ID: 19649
  Gene Name: Zic family member 4
  Uniprot ID: Q8N9L1
  ENST ID: ENST00000425731
  CDS Start-End: 50-1168
gaaagaaagctaggactggctcaaaggttggatctgaaagttggggttgatgaatggcccatgtcaaagtcttaggaaagcggaggggcttttggagggttgcacttcggccgtcaccgtcttcaggaaactccctttggattccaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 200894 - DNA, 1774 bp, Homo sapiens
  Payload ID: 19649
  Gene Name: Zic family member 4
  Uniprot ID: Q8N9L1
  ENST ID: ENST00000484399
  CDS Start-End: 337-1341
gagaagtgatccagacctcttagaagttgggttggggctgccttatgggtggacagggatctctagggaacctcacacccatttcccccagaagcaaaagagtaaattctattattgccaaccaaccaggacttttccatgccagacatcctgccatgaggaaatttcagagcgaggacgcccagcatgccgcccttctgtaggaatgcaaagttaggcctcctttctttcctgatttgtgctggaaggagcttattacctttggggaagaatgccttttggttagaaagaattgaaaataataataccctctgggaaaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcaga

SEQ ID NO: 200895 - DNA, 925 bp, Homo sapiens
  Payload ID: 19649
  Gene Name: Zic family member 4
  Uniprot ID: Q8N9L1
  ENST ID: ENST00000491672
  CDS Start-End: 444-830
aaaaaagaaaagtcagtcttctcctctccagtccgtggaaaatccaacggggacgttgacaagagggtatttttaggaaacacatccaaatatacagggtaagagtgaatgtgagaaaaaaaaaagttgtgggttgtagaagttatcaagtgggatttgcggcgctctctgcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcag

SEQ ID NO: 200896 - DNA, 500 bp, Homo sapiens
  Payload ID: 19649
  Gene Name: Zic family member 4
  ENST ID: ENST00000484586
  CDS Start-End: 268-500
ccacttggatttggcctgtggttcaacaagttaaacaactgcttgttctgtgggcagacatccccattgacagaggacttgctgtgtttgtccagcctgagaccttttcaatgactgtttttctttctaggccaaattgagggtgggggccggatagatgcttctgtctggctgctcaactgcctcagccttgcctgacagatgcagaggtcctcaggatggctttaagtatttaaggcggccaatggcttggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagccctt

SEQ ID NO: 200897 - DNA, 565 bp, Homo sapiens
  Payload ID: 19649
  Gene Name: Zic family member 4
  ENST ID: ENST00000463250
  CDS Start-End: 361-565
gcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtgggggtcaaagcgccaagttagcccagatggcagcaagacgatggaacttctccgccccaacctgacggcagatgccgcctgagtccacctcagggcggctccttgccctccctcaccctggtcctgcctcaggaagctgactgctgggatctgctctctgcgcgcggccagcagtgggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctg

SEQ ID NO: 200898 - DNA, 929 bp, Homo sapiens
  Payload ID: 19649
  Gene Name: Zic family member 4
  ENST ID: ENST00000462748
  CDS Start-End: 242-929
gcagaggatgagtccatcccttcttcccaggaggagggaaaaggggtacaaatggggctcccactggcacaggaaccaggagcagtttgttgcctgcctgccttcccttctctccttgtgaattgcctgggtgccccaccgtgggcacaagaatggaagtcgtggcccagagcttccctcgcgaaaaatgagcaaggcgggtgccgggagggggcctttacaggaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacag

SEQ ID NO: 200899 - DNA, 1481 bp, Homo sapiens
  Payload ID: 19649
  Gene Name: Zic family member 4
  Uniprot ID: Q8N9L1
  ENST ID: ENST00000473123
  CDS Start-End: 164-1168
gaaagaaagctaggactggctcaaaggttggatctgaaagttggggttgatgaatggcccatgtcaaagtcttaggaaagcggaggggcttttggagggttgcacttcggccgtcaccgtcttcaggaaactccctttggattccaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaa

SEQ ID NO: 200900 - DNA, 4152 bp, Homo sapiens
  Payload ID: 19649
  Gene Name: Zic family member 4
  Uniprot ID: Q8N9L1
  ENST ID: ENST00000525172
  CDS Start-End: 187-1341
gagaagtgatccagacctcttagaagttgggttggggctgccttatgggtggacagggatctctagggaacctcacacccatttcccccagaagcaaaagagtaaattctattattgccaaccaaccaggacttttccatgccagacatcctgccatgaggaaatttcagagcgaggacgcccagcatgccgcccttctgtaggaatgcaaagttaggcctcctttctttcctgatttgtgctggaaggagcttattacctttggggaagaatgccttttggttagaaagaattgaaaataataataccctctgggaaaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 200901 - DNA, 4639 bp, Homo sapiens
  Payload ID: 19650
  Gene Name: Zic family member 5
  Uniprot ID: Q96T25
  ENST ID: ENST00000267294
  CDS Start-End: 235-2226
ggggcgaatccccgctgggtcgagggcctgaacgggagccaatcgagcagccgaggctactgccaatcacgcggctccctccaatcccacccgtgccatttccaaaatctcggtcccactgtgcagctcaaatgtggtgttcactctgccaatcgctggaggatagagtgggaacaggaataagcagagttaagaggccaggacaaaagaagttaaagagcgcccaatacatacatgtttttgaaggcgggcagagggaataaagtccccccagtgagggtctatgggcctgattgtgtagttctgatggagccccctttgagcaagaggaacccgccagcgctgagattagcggatttggcaacggctcaggtccagccgcttcagaatatgacaggcttcccggcgctggccggcccgcccgcccactcccaactccgggccgccgtcgcgcacctccgcctgcgggacctgggcgctgaccccggcgtggccaccactccgctcggacccgagcacatggcccaggcgagcacgctgggcctcagccctccctcccaggcgttcccggcacacccggaggctccggcagccgccgcccgtgctgcagccttggtcgcgcaccccggcgcgggcagctacccctgcggcgggggcagcagtggcgcgcagccctccgcgcccccgcccccagcccctcctcttcctcccaccccttcaccccctccccctcccccgcctcctcctcctcctgccctctcgggctacaccaccaccaacagtggcggcggcggcagcagcggcaaaggccacagcagggacttcgtcctccggagggacctttccgccacggcccccgcggcggccatgcacggggccccgctcggaggggagcagcggtccggcaccggctccccccagcacccggccccgcctccccactcggccggcatgttcatctccgccagcggcacctacgcgggcccggacggcagcggcggcccggcgctcttccccgcgctgcacgacacgccgggggccccaggcggccacccgcacccgctcaacggccagatgcgcctggggctggcggcggcagcggcagccgcggcggctgagctgtacggccgcgccgaaccgcccttcgcgccgcgctctggggacgcgcactacggggcggttgcggccgcagcggcggccgccctgcacggctacggagccgtgaacttaaacctgaacctggcggctgcggcggccgcagcagcggccgggcccgggccccacctgcagcaccacgcgccgcccccggcgccgccgccgccgccggcgcccgcgcagcacccgcaccagcaccacccccacctcccaggggcggctggggccttcctgcgctacatgcggcagccaatcaagcaggagctcatctgcaagtggatcgaccccgacgagctggccgggctgccgccgccgccgccgccgccgccgccgccgccgccaccgcccccggccggcggcgccaagccctgctccaaaactttcggcaccatgcacgagctggtgaatcacgtcacggtggagcacgtgggaggccccgagcagagcagccacgtctgcttctgggaggactgtccgcgcgagggcaagcccttcaaggccaaatacaagctcatcaaccacatccgcgtgcacaccggcgagaagccctttccctgccctttccccggctgcggcaaggtcttcgcgcgctccgagaacctcaagatccacaagcgtactcatacaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaagatatttgggcttttttttttttttttcttaaaaaacaaacaaaaaacaaccaagctggacttgtacattgcaggaggatggggctgggggcaaattgtaccaaggaaaatgaatggagagattagttaatggcgatacacactgccgatgcaatatatatatatatatatatatacatatatatatatattattttttttaaaagggggagaaaaagagcattaagtcagaacttaacacagcaccaaggccctctgcatttcccagagtgcctctcaaatgcctttgacaccataccatgggctgcttttgagcctccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaatagaagaaattcaagtgctttctttttcctatatgtttttttttttttatctgaattctcagatactgcctcctaactgtgtccaaacttcttgtgtaataaagagattctgttttcgatcctaagttctttgggatgccaacattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatcctacagatacactaaagagcactaatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtgtacctccaatagagagcaagcaagaatgattatgaagtaacaaatttaataaaggtattcttgttattattgcttatgttttacataatggcatatctctcatacaaatagaacaggttgctaatgga

SEQ ID NO: 200902 - DNA, 1335 bp, Homo sapiens
  Payload ID: 19651
  Gene Name: zinc activated ligand-gated ion channel
  Uniprot ID: Q401N2
  ENST ID: ENST00000334586
  CDS Start-End: 84-1322
aattgctcagctgccagagaagtgactggaatagaggttgtagcttaggcaccgctgctccctccagtccctccgtgcagccgatgatggccctatggtccctgctccatctcaccttcctggggttcagcattaccttgctgttggtccacgggcagggcttccaagggacagcagccatctggccatccctcttcaacgtcaacttgtccaagaaggttcaggaaagcatccagatcccgaacaatgggagtgcgcccctgctcgtggatgtgcgggtgtttgtctccaacgtgtttaatgtggacatcctgcgatacacaatgtcctccatgctgctgcttaggctgtcctggctggacactcgcctggcctggaacactagtgcacacccgcggcacgccatcacgctgccctgggagtctctctggacaccaaggctcaccatcctggaggcgctctgggtggactggagggaccagagcccccaggctcgagtagaccaggacggccacgtgaagctcaacctggccctcgccacggagaccaactgcaactttgagctcctccacttcccccgggaccacagcaactgcagcctcagcttctacgctctcagcaacacggcgatggagttagagttccaggcccacgtggtgaacgagattgtgagtgtcaagagggaatacgtagtttatgatctgaagacccaagtcccaccccagcagctggtgccctgcttccaggtgacgctgaggctgaagaacacggcgctcaagtccatcatcgctctcttggtgcctgcagaggcactgctgttggctgacgtgtgcggggggttgctgcccctccgggccattgagcgcataggctacaaggtgacattgctgctgagttacctcgtcctccactcctccctggtgcaggccctgcccagctcctcctcctgcaacccactgctcatttactacttcaccatcctgctgctgctgctcttcctcagcaccatagagactgtgctgctggctgggctgctggcccggggcaaccttggggccaagagcggccccagcccagccccgagaggggaacagcgagagcacggcaacccagggcctcatcctgctgaagagccctccagaggagtaaaggggtcacagagaagctggcctgagactgctgaccgcatcttcttcctcgtgtatgtggttggggtgctgtgcacccaattcgtctttgcaggaatctggatgtgggcagcgtgcaagtctgacgcagcccctggagaggctgcaccccatggcaggcggcctagactgtaaaggggcagggcct

SEQ ID NO: 200903 - DNA, 1291 bp, Homo sapiens
  Payload ID: 19651
  Gene Name: zinc activated ligand-gated ion channel
  Uniprot ID: Q401N2
  ENST ID: ENST00000421794
  CDS Start-End: 38-418
aggcaccgctgctccctccagtccctccgtgcagccgatgatggccctatggtccctgctccatctcaccttcctggggttcagcattaccttgctgttggtccacgggcagggcttccaagggacagcagccatctggccatccctcttcaacgtcaacttgtccaagaaggttcaggaaagcatccagatcccgaacaatgggagtgcgcccctgctcgtggatgtgcgggtgtttgtctccaacgtgtttaatgtgtcttctgtcctccccagagcaactgccctccacagccatggcgactgcagtggctcggccccttgcagcaaggccagaggctcaggttgccatggcctcactcctggaaaccacctgaaggtgcagccaccctgtataaacccatcaggtgacatctaacttggcagagaagtcctacccttccctccatgagagaccacagcggtagccctggggatcctgcttcagctgtgagatgatagactgacgagcctgtgaccacttctccctccatcatgaagtggtgcaaagtacatttatttttacaatgaaagctcatctatgaatctgataaaggccttccttcaactggagacaatttgggatgttgcaaaacaagcgatggagttagagttccaggcccacgtggtgaacgagattgtgagtgtcaagagggaatacgtagtttatgatctgaagacccaagtcccaccccagcagctggtgccctgcttccaggtgacgaggcactgctgttggctgacgtgtgcggggggttgctgcccctccgggccattgagcgcataggctacaaggtgacattgctgctgagttacctcgtcctccactcctccctggtgcaggccctgcccagctcctcctcctgcaacccactgctcatttactacttcaccatcctgctgctgctgctcttcctcagcaccatagagactgtgctgctggctgggctgctggcccggggcaaccttggggccaagagcggccccagcccagccccgagaggggaacagcgagagcacggcaacccagggcctcatcctgctgaagagccctccagaggagtaaaggggtcacagagaagctggcctgagactgctgaccgcatcttcttcctcgtgtatgtggttggggtgctgtgcacccaattcgtctttgcaggaatctggatgtgggcagcgtgcaagtctgacgcagcccctggagaggctgcaccccatggcaggcggcctagactgtaaaggggcagggcct

SEQ ID NO: 200904 - DNA, 2167 bp, Homo sapiens
  Payload ID: 19651
  Gene Name: zinc activated ligand-gated ion channel
  Uniprot ID: Q401N2
  ENST ID: ENST00000425015
  CDS Start-End: 84-884
aattgctcagctgccagagaagtgactggaatagaggttgtagcttaggcaccgctgctccctccagtccctccgtgcagccgatgatggccctatggtccctgctccatctcaccttcctggggttcagcattaccttgctgttggtccacgggcagggcttccaagggacagcagccatctggccatccctcttcaacgtcaacttgtccaagaaggttcaggaaagcatccagatcccgaacaatgggagtgcgcccctgctcgtggatgtgcgggtgtttgtctccaacgtgtttaatgtggacatcctgcgatacacaatgtcctccatgctgctgcttaggctgtcctggctggacactcgcctggcctggaacactagtgcacacccgcggcacgccatcacgctgccctgggagtctctctggacaccaaggctcaccatcctggaggcgctctgggtggactggagggaccagagcccccaggctcgagtagaccaggacggccacgtgaagctcaacctggccctcgccacggagaccaactgcaactttgagctcctccacttcccccgggaccacagcaactgcagcctcagcttctacgctctcagcaacacgggtgctgacagggcaggggctgcagggttgaggaggggaggaggaaggtgggggaggggaactcccaggtctgtggtgcaggggcagggtgcggggcaaggggaaggggcaaaggcagacagaaggcgaactcccaggtctgtgttcagagcagtctaccccaggcttaggcgggcagcacctgctctcccactgcgccccccactcgagtggcagcccatctctgtgctcagcggtagcctcagggcccctctctagggtgacagactcaaacattcgcagcagctctgcaatcccagaggtccgagcacatcagtcttctgtcctccccagagcaactgccctccacagccatggcgactgcagtggctcggccccttgcagcaaggccagaggctcaggttgccatggcctcactcctggaaaccacctgaaggtgcagccaccctgtataaacccatcaggtgacatctaacttggcagagaagtcctacccttccctccatgagagaccacagcggtagccctggggatcctgcttcagctgtgagatgatagactgacgagcctgtgaccacttctccctccatcatgaagtggtgcaaagtacatttatttttacaatgaaagctcatctatgaatctgataaaggccttccttcaactggagacaatttgggatgttgcaaaacaagcgatggagttagagttccaggcccacgtggtgaacgagattgtgagtgtcaagagggaatacgtagtttatgatctgaagacccaagtcccaccccagcagctggtgccctgcttccaggtgacgctgaggctgaagaacacggcgctcaagtccatcatcgctctcttggtgcctgcagaggcactgctgttggctgacgtgtgcggggggttgctgcccctccgggccattgagcgcataggctacaaggtgacattgctgctgagttacctcgtcctccactcctccctggtgcaggccctgcccagctcctcctcctgcaacccactgctcatttactacttcaccatcctgctgctgctgctcttcctcagcaccatagagactgtgctgctggctgggctgctggcccggggcaaccttggggccaagagcggccccagcccagccccgagaggggaacagcgagagcacggcaacccagggcctcatcctgctgaagagccctccagaggagtaaaggggtcacagagaagctggcctgagactgctgaccgcatcttcttcctcgtgtatgtggttggggtgctgtgcacccaattcgtctttgcaggaatctggatgtgggcagcgtgcaagtctgacgcagcccctggagaggctgcaccccatggcaggcggcctagactgtaaaggggcagggcctgggctgcacaccttaggatgaagtttgctttcccatggctgggggcgggccatgacagggcctctggattaagccaccctgagctctccctccgctagcacacaagcacagagcgtgaaataaacccatctccagtgc

SEQ ID NO: 200905 - DNA, 2479 bp, Homo sapiens
  Payload ID: 19652
  Gene Name: zinc and ring finger 1, E3 ubiquitin protein ligase
  Uniprot ID: Q8ND25
  ENST ID: ENST00000320619
  CDS Start-End: 636-1472
cggcgaggagcgccggcgagcgcagcccgggaccgagcggggcggcgcggctggcggggccggcggcggctgaagcgagagcgcgacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacggaagaatacaaagaagcctcagaggggctcagcctgagaaaacctggctctcaggaagaactttgcaagagcagccgtggaggacagagtgctcttgggcccccatggcccaaatgcagagttacccccactgccctgtggagaaccgggaagatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaa

SEQ ID NO: 200906 - DNA, 4620 bp, Homo sapiens
  Payload ID: 19652
  Gene Name: zinc and ring finger 1, E3 ubiquitin protein ligase
  Uniprot ID: Q8ND25
  ENST ID: ENST00000335325
  CDS Start-End: 643-1326
tccacggcggcgaggagcgccggcgagcgcagcccgggaccgagcggggcggcgcggctggcggggccggcggcggctgaagcgagagcgcgacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacactttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctc

SEQ ID NO: 200907 - DNA, 1234 bp, Homo sapiens
  Payload ID: 19652
  Gene Name: zinc and ring finger 1, E3 ubiquitin protein ligase
  Uniprot ID: Q8ND25
  ENST ID: ENST00000567962
  CDS Start-End: 328-1011
ccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaa

SEQ ID NO: 200908 - DNA, 1069 bp, Homo sapiens
  Payload ID: 19652
  Gene Name: zinc and ring finger 1, E3 ubiquitin protein ligase
  ENST ID: ENST00000566250
  CDS Start-End: 328-957
ccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaaggtaggaggggttggcaaggtagcttagtgcaccccacctcccagaggggcggacccccatctccagccattctgtctcctttggttatgggatgacctctcccccgacctctggct

SEQ ID NO: 200909 - DNA, 964 bp, Homo sapiens
  Payload ID: 19652
  Gene Name: zinc and ring finger 1, E3 ubiquitin protein ligase
  ENST ID: ENST00000568351
  CDS Start-End: 1-236
atgatgtgctgactaaagacgcgggtgagtgtgtgatctgcctggaggagctgctgcagggggacacgatagccaggctgccctgcctgtgcatctatcacaaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtattta

SEQ ID NO: 200910 - DNA, 485 bp, Homo sapiens
  Payload ID: 19652
  Gene Name: zinc and ring finger 1, E3 ubiquitin protein ligase
  ENST ID: ENST00000568511
  CDS Start-End: 328-485
cttccaggacatctgtttcctctgttacacattgctgcaagaagcaaaacttgtttctgctttggagcctttgagatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaag

SEQ ID NO: 200911 - DNA, 3460 bp, Homo sapiens
  Payload ID: 19653
  Gene Name: zinc and ring finger 2, E3 ubiquitin protein ligase
  Uniprot ID: Q8NHG8
  ENST ID: ENST00000323037
  CDS Start-End: 1052-1780
gcgggccacgtgcgggaggaggggccgccttctggttggcgcccggtgtccgttcctcctatcggcgtaggccccgcgaggaagacaagggcgcgccctggctgggagggcgtggccagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatga

SEQ ID NO: 200912 - DNA, 2667 bp, Homo sapiens
  Payload ID: 19654
  Gene Name: zinc and ring finger 3
  Uniprot ID: Q9ULT6
  ENST ID: ENST00000402174
  CDS Start-End: 94-2604
gcacagaagtttgctgcatcactggtgagctggggagtgtcctgtgtggtgtccacttaatcttactaggaaggatcccctcatttcaacaagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttc

SEQ ID NO: 200913 - DNA, 2878 bp, Homo sapiens
  Payload ID: 19654
  Gene Name: zinc and ring finger 3
  Uniprot ID: Q9ULT6
  ENST ID: ENST00000406323
  CDS Start-End: 25-2535
ttttctttccattttatttcctagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttattta

SEQ ID NO: 200914 - DNA, 6851 bp, Homo sapiens
  Payload ID: 19654
  Gene Name: zinc and ring finger 3
  Uniprot ID: Q9ULT6
  ENST ID: ENST00000544604
  CDS Start-End: 176-2986
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 200915 - DNA, 1426 bp, Homo sapiens
  Payload ID: 19655
  Gene Name: zinc and ring finger 4
  Uniprot ID: Q8WWF5
  ENST ID: ENST00000222033
  CDS Start-End: 62-1351
atctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgtcctggccacaggccccctgggagaccccggagatgcccaaaggcctcatgcctgccgcctccagtgggacctagcagcacacagacagcgaagcgggtgaccatggggtggccacggccgggccgagccctcgtggcagtcaaagccttgctggtcttgtcgctgctccaggtgcccgcgcaggcagtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggcgccatcgtgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcgga

SEQ ID NO: 200916 - DNA, 7732 bp, Homo sapiens
  Payload ID: 19656
  Gene Name: zinc binding alcohol dehydrogenase domain containing 2
  Uniprot ID: Q8N4Q0
  ENST ID: ENST00000322342
  CDS Start-End: 291-1424
ttcaaaccaaaacaaaaagattaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattccgcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaactgataaaaaagaccaagcactatcaactttggacagtaatttcctaggtgttaaacaagttttctgaatacaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttggcaaaagaaaaaaaaaagttacacaaaacacacaaataacattttaataatatgtatcagatcaagtgattcttagtagtagttgatattcacaggaagtcaaaaaaggacctatttcaattatgtctgcttgaatcctgtttaattgtttccctggctgagtagctagtgtgacacagcagcaagactaaaggggctctgtggtccacattgtcctcgagtctattcttgcccattatagacctgcccattggtgctcactcactgcatcccaggaggcttgactgtcctcaggaagcatgttggggtgcccttaagggtaagtatcccggggagcacagtttggagaaaaccaatacgtcttcatgtatgttgagaagcgctgggccaaagtacagactttttttttttttttttttttttttgggacaagacctcggctctgtcacccaggctggagtgcagtggtgcaatcatggttgattgcaacctcaacctccctggttcaagccatcctcccacctcagtctcctgagtagctgggactacaggtgcacatcaccatgcccggctaatttttttgtatttttttactagagatgaggttctactatgtagcccaggctgctctggaactcctgggctcaagcaatcctcccacctcggcctcccaaagtgctgggattgcaggcatgagccaccatactggcctaagtgcagaaatttgaacatgtgcctccaccccaagccaaaatttcccttgaggagcactatctatctgatgatgtctttgaaacggtatgaaattaaaataattaaaacatcctgcacataggtggtagcatctaatatgaaagatggatttatgcttagagctcagaaaaatcctcataaaattattgtgtcttatcctcggcacctaaagaactgaacagggtcttagaatgatcaaatggatggtttgtttggttggtgggagatgttgaaacgtgggtaaggaatggtgtccttagaagagaggttgccctagatgccgaaaccctggaggtccatggttgccagcagaaacttacagctgggaggagcctgcacccatctctggctcttgtgaatgagaagactcaatttgtgtttttgtttttttgagaaagggtcttgctctgtcacccagactgaagtacagtagcgtgatctcagttcactgcagccttgacctcctgggcccaagcgatcctcccacctcagcctcctgagtagttaagacttcaggtatgcattaccatgcctggctaatgtttttttattttttgtagagacaaggtctccctcgttgcccaggctggtctcaaactcttgggctcaagtgactttcctgcctcggccatccaaagtgctgggattacaggcataagccaccgcaacatgccccagttgcttttaaactgttaaatgtgggatttaaagaataatctagttctacccattttatgaatgaagaaaagaaactgggacccagagagaaaaggtgcccggtccaaggttacagagcccgttggactcagaagtgaagctggaacactggccaatgccctcccatccgccaggtgacttctctgcagtcccctttaccatctgcccgggtcctttgggatacggctgactaggggtttgaagaacagcaattggcctttgttatgaatctttttgtggagataaacccagtagaagtatcacggttctgaccatgaaagtgtgttcaactctaatccagcacaattaggattccagatcatttgattctgtgtcgtctaaatatcacagaaagttaaaaacaaattagcctcaatggaattaatggcttaatatccataatttagttttaatgctaggaggaagggctcctgtgaatgtgttcttacaaatcaaataaagaaaatcaaatagagaaaa

SEQ ID NO: 200917 - DNA, 3205 bp, Homo sapiens
  Payload ID: 19656
  Gene Name: zinc binding alcohol dehydrogenase domain containing 2
  Uniprot ID: Q8N4Q0
  ENST ID: ENST00000537114
  CDS Start-End: 482-1246
gatttggagaatgcctgcgccggtcctattcttttttcctggggtttctggattttagtcttttaagtggatcctcccgtcggattactagaatcctgcgctcactgcatgcacacagtttcaattaaagggggggtgggggtacaaggagggtctccaaatgcgcgaatccttcccagtgtgtctttcttgtctttctgtggctccctggcccttccgcccctgctccccatcccgagccccgcattcgctttgcgcctgctgcgcttgaacttgtttctggtggagcggaaggcgcgagctgcggaccctcacgcagagatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaata

SEQ ID NO: 200918 - DNA, 671 bp, Homo sapiens
  Payload ID: 19656
  Gene Name: zinc binding alcohol dehydrogenase domain containing 2
  ENST ID: ENST00000582437
  CDS Start-End: 208-671
ctttagggtggagcgggagcagcctggacgcaaactgcgacgtttagatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcc

SEQ ID NO: 200919 - DNA, 520 bp, Homo sapiens
  Payload ID: 19656
  Gene Name: zinc binding alcohol dehydrogenase domain containing 2
  ENST ID: ENST00000581620
  CDS Start-End: 218-520
aaacgtgcttcggaggaaggaggctgggacccggctggctttccctgttccctccagatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactat

SEQ ID NO: 200920 - DNA, 1673 bp, Homo sapiens
  Payload ID: 19657
  Gene Name: zinc finger (CCCH type), RNA-binding motif and serine/arginine rich 1
  Uniprot ID: Q15695
  ENST ID: ENST00000391338
  CDS Start-End: 219-1658
aatttatgatatacttaattacaaaaaaagtctaactgcaatataaaggagaaacaaaatgaaagtaatttgtaatatatataagtatgcaaacaaaacaatactagaaaacataaaatattcataagtagaatcactgacagtggcagctatgaacaaaatcttccatatattcccataggttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttctt

SEQ ID NO: 200921 - DNA, 1491 bp, Homo sapiens
  Payload ID: 19658
  Gene Name: zinc finger (CCCH type), RNA-binding motif and serine/arginine rich 2
  Uniprot ID: Q15696
  ENST ID: ENST00000307771
  CDS Start-End: 25-1473
gaggggcggggcggtgccggcaagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggaagctttgcagaagatgctggatcaggctgaaaatgagttggaaaatggtaccacatggcaaaacccagaaccacccgtggatttcagagtaatggagaaggatcgagctaattgtcccttctacagtaaaacaggagcttgcagatttggagatagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcagtgtgaattctgccccgtgacccggtggaaaatggcgatttgtggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaa

SEQ ID NO: 200922 - DNA, 744 bp, Homo sapiens
  Payload ID: 19658
  Gene Name: zinc finger (CCCH type), RNA-binding motif and serine/arginine rich 2
  ENST ID: ENST00000380308
  CDS Start-End: 25-468
gaggggcggggcggtgccggcaagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggctggagtgcagtggtgtgatctccgctcaccgcaacctccacctcccaggttcacacgattctcctgcctcagcctcccgagtagccgggattacaggcacgcaccgccacacccagttaatttttttttgtacttttagtagagatggggtttcaccatgttggccaggatggtctcgatctcttgacctcatgatctgcccgcctcggcctcacaaagtgctgagattacaggtgtgagccaccgcgctcagccgaaatttcttaatgtctctaagcttctatttccttgtctgtaatatggagataaagtcaatcacagtatccacctcacagaattgtgaagattaaaggaggtgatggatgtatagtgtttaacacagtgtcagcagatgagaggtgctgtgatagctctagttcttattattatagatttctgttatgatgaagacaatagatacggtatgaaataagagagtaatttttttcctgtttatttgaaatgcttcttttaaa

SEQ ID NO: 200923 - DNA, 4597 bp, Homo sapiens
  Payload ID: 19659
  Gene Name: zinc finger and AT hook domain containing
  Uniprot ID: Q9P243
  ENST ID: ENST00000377838
  CDS Start-End: 176-3907
agactccatccgccatgttggatgccgcagattcgccataacctcgccggctcttttcttaaaaaaataaaaataaaaagcgaagcgtcagcagggcgccccgccccctcggtcggcacgggagggggcccggaagagcccgaggcttttttttcctccgcggtggggcgttgccatggagacgcgggcggcagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 200924 - DNA, 4421 bp, Homo sapiens
  Payload ID: 19659
  Gene Name: zinc finger and AT hook domain containing
  ENST ID: ENST00000429442
  CDS Start-End: 146-3616
gagagtgcaggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 200925 - DNA, 4686 bp, Homo sapiens
  Payload ID: 19659
  Gene Name: zinc finger and AT hook domain containing
  Uniprot ID: Q9P243
  ENST ID: ENST00000520727
  CDS Start-End: 301-3996
gtgcaggagtctgagaagaaagggtgtagatggagaggcggtggcctcacctctgcatgctccgtgggaagcggcggaggcgcccagcatccctcctactctgcccttggtggaggtttacgaggtctgctggagtttgctggaggtccgctccataccctgtttgcctgggtatcaccagtggaggctgcagaacaacaaagattgctgcctgttcctgcctctggaagcttcgtcccagaggggcacctgccagatgccagccagagctctcctgtatgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 200926 - DNA, 4273 bp, Homo sapiens
  Payload ID: 19659
  Gene Name: zinc finger and AT hook domain containing
  ENST ID: ENST00000520356
  CDS Start-End: 142-3579
gtgcaggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctgaa

SEQ ID NO: 200927 - DNA, 594 bp, Homo sapiens
  Payload ID: 19659
  Gene Name: zinc finger and AT hook domain containing
  ENST ID: ENST00000518191
  CDS Start-End: 144-594
gagtgcaggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtgctaccaagattgtgccagtggaggctgggccccctg

SEQ ID NO: 200928 - DNA, 4294 bp, Homo sapiens
  Payload ID: 19659
  Gene Name: zinc finger and AT hook domain containing
  Uniprot ID: Q9P243
  ENST ID: ENST00000520214
  CDS Start-End: 142-3837
gtgcaggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacggg

SEQ ID NO: 200929 - DNA, 4756 bp, Homo sapiens
  Payload ID: 19659
  Gene Name: zinc finger and AT hook domain containing
  ENST ID: ENST00000523924
  CDS Start-End: 176-352
agactccatccgccatgttggatgccgcagattcgccataacctcgccggctcttttcttaaaaaaataaaaataaaaagcgaagcgtcagcagggcgccccgccccctcggtcggcacgggagggggcccggaagagcccgaggcttttttttcctccgcggtggggcgttgccatggagacgcgggcggcaggtctgctggagtttgctggaggtccgctccataccctgtttgcctgggtatcaccagtggaggctgcagaacaacaaagattgctgcctgttcctgcctctggaagcttcgtcccagaggggcacctgccagatgccagccagagctctcctgtatgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 200930 - DNA, 3734 bp, Homo sapiens
  Payload ID: 19659
  Gene Name: zinc finger and AT hook domain containing
  Uniprot ID: Q9P243
  ENST ID: ENST00000523399
  CDS Start-End: 100-3645
aaagcgaagcgtcagcagggcgccccgccccctcggtcggcacgggagggggcccggaagagcccgaggcttttttttcctccgcggtggggcgttgccatggagacgcgggcggcagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccg

SEQ ID NO: 200931 - DNA, 752 bp, Homo sapiens
  Payload ID: 19659
  Gene Name: zinc finger and AT hook domain containing
  ENST ID: ENST00000521673
  CDS Start-End: 1-492
aacttgtggaatttcttggcacacactttcattgagtctgcggctgaacgggcttgctgggtgctcccaggagttcagcttcgagggcagccacatgtccgcatgttaggactcagagcacgcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtg

SEQ ID NO: 200932 - DNA, 4774 bp, Homo sapiens
  Payload ID: 19659
  Gene Name: zinc finger and AT hook domain containing
  ENST ID: ENST00000523243
  CDS Start-End: 187-3183
gaggagggcgaagactccatccgccatgttggatgccgcagattcgccataacctcgccggctcttttcttaaaaaaataaaaataaaaagcgaagcgtcagcagggcgccccgccccctcggtcggcacgggagggggcccggaagagcccgaggcttttttttcctccgcggtggggcgttgccatggagacgcgggcggcagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagaagcgtagcattgctctgtaatttggaaaccaagtcaaagatgtgtaagaggatgcagacagaagaaaaggcacgatctttgcataaaagcactggagtgatttagaggaaggcttgcaggctttagggacacgtatttttgctttcagatcctggattgctgcagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 200933 - DNA, 684 bp, Homo sapiens
  Payload ID: 19659
  Gene Name: zinc finger and AT hook domain containing
  ENST ID: ENST00000522257
  CDS Start-End: 97-684
tgtgtctgcgggatggcagagtctgtcactgggtttagacctgggccgcaggcttcagtaaactcttaggcaccctgtttctggaactcagctgacatgacacgagagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatg

SEQ ID NO: 200934 - DNA, 659 bp, Homo sapiens
  Payload ID: 19659
  Gene Name: zinc finger and AT hook domain containing
  ENST ID: ENST00000519827
  CDS Start-End: 1-296
gcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggtctttggtggaggatcttgtaacacaatgaatgaatgcttatttttgcaaattctaatctaactcaagaggctgacacctgagagtgatttgagacttcttcaagttataaaggaagcacatctggccccaggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaa

SEQ ID NO: 200935 - DNA, 4119 bp, Homo sapiens
  Payload ID: 19660
  Gene Name: zinc finger and BTB domain containing 1
  Uniprot ID: Q9Y2K1
  ENST ID: ENST00000358738
  CDS Start-End: 392-2326
cgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccagtggtgaaatagggccttctaaacctgtggagaagtgagagatctgaatttggagaggacatggggaagaatcaatcttcaacagataatctttaagtacagacccaggaatatcagatctgaagtggcaccatcttttctgtcttcctgacaaacttccatcaacccaaaaagttccagttgcaaagatccaagaaaactcagtaaagatcactttggaatcactttgttgtaacaaaattgattcatggtgactctaatatttgtgtaaatctgctgaagaaaagtaactagaaaattcatacaacatcagtggttacagctatactaaaataaaactttatatgctaattatcttcaagggtctttctaaaataaaaggggttgttaggctactgcaaatataaagagacataatcacaaatctatttatatagatataaataattctaaacttaaaatcactagaattatagcttaaatattatgaaatgtacttagtcaacttaaaaacttacaccaaaaatctgtagtttagagtgtaagaagtaatgggtacagagaaaaaaaatttaagaccaatattttaacaggataatttggttattactcactatagtaaaacacttgcccttcttccttttccactgtatatgccagtcacaatcttgatcatttatatgaatgaaactcccttttaaacctgttaacttgaaggagaacagaaatggtattacttcaatagtggtagatttccacaaatcagacacattattttcttctgaacttggcaatataacctaataaggcagaataagtttctgttaaaatacttattctcaatatttatgtataaaccatgcttctcagctttcaaatttcaagataaaatttaagtattcagtaaaatgatggttaacatgttttaaaaaatctttaatggagaagttaaatatttggtgagattttagtctggctataaatgctttgtttgatatatatatgtgcacatatatatattacttaaccatatgaattttatttccttattctgaatatacttgtagttttacttctttctgtttatgtacccaattccttatgattattttgtttcttctgcaatatcaagatgttatttattttgagaaatgcttatttttatgactatttattccaatgttttaacaagaagcacagagatttatagtattcttaatagtatgtgcagaagttacatcatttaaaaaacccttgctgtaaagtaggataacttgaatattcattctaataattagactaagtgaaaatctgagaaagagttaattgcaatgtgatagtgggtagaaaggagagaaaaacccactgaagggttcaaatacatgtgaattctactgctttaagagaaataaaacaaataagcctagggaaatattagagtctaaaaaaccctagagttaatctcttttgggaacataaggaggtatacagaactgcagacctctaaacataagtaggaaaaagaaaaataaaagaatattaccaataattaaaggtgccagatcaaaatagtaataaatcaacaaataatttttgattgactggtggaattagatttactaaataaaaatggcttaaattttgactgtactaactataaatgtaatgaattataataattataaatggtataaatgcattctacaatgtgattattttctgtattttagtatatagtataaaatggaattattgggttaaagtacttttattacatttcttaatccattgtttttacctaataaaatttcctcctctatattccaaagtt

SEQ ID NO: 200936 - DNA, 509 bp, Homo sapiens
  Payload ID: 19660
  Gene Name: zinc finger and BTB domain containing 1
  ENST ID: ENST00000556965
  CDS Start-End: 119-509
acagttcgcagttgtgactctgtaggcggaagcatagggacaagcctgagcgtcacaggctccccacaaacaaccgcgtgacccggggactttccccagggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgctt

SEQ ID NO: 200937 - DNA, 2825 bp, Homo sapiens
  Payload ID: 19660
  Gene Name: zinc finger and BTB domain containing 1
  Uniprot ID: Q9Y2K1
  ENST ID: ENST00000554015
  CDS Start-End: 432-2573
tagggacaagcctgagcgtcacaggctccccacaaacaaccgcgtgacccggggactttccccagggtgtgcaaaagcacaggcaccccctcagttctggggtgaagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccgtgccctctggtggtcagaagatgctgtgctgtctcgttaggatgaatggattaaaatgtacttttcctcctctgcttctggagagggagagaggaatattccagaagccactgtgttccttctgctttctgtgtgggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgta

SEQ ID NO: 200938 - DNA, 629 bp, Homo sapiens
  Payload ID: 19660
  Gene Name: zinc finger and BTB domain containing 1
  ENST ID: ENST00000555321
  CDS Start-End: 528-629
agtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccgtgccctctggtggtcagaagatgctgtgctgtctcgttaggatgaatggattaaaatgtacttttcctcctctgcttctggagagggagagaggaatattccagaagccactgtgttccttctgctttctgtgtggcatgatgccttcttctgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtctctaattaacagaagatggcaaagcccagccacagcagctatgtccttcagcagctaaacaaccaaagagaatggggttttctctgtgactgctgtattgcaattgatgacatttac

SEQ ID NO: 200939 - DNA, 582 bp, Homo sapiens
  Payload ID: 19660
  Gene Name: zinc finger and BTB domain containing 1
  ENST ID: ENST00000553583
  CDS Start-End: 117-582
actgcaagcagtggcgccggctcacgcacccctcggccgcctctcgcgcggcttcccgcgccggcagcccgcgatggccccacgtgaccgcgtgtctggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaag

SEQ ID NO: 200940 - DNA, 2181 bp, Homo sapiens
  Payload ID: 19661
  Gene Name: zinc finger and BTB domain containing 10
  Uniprot ID: Q96DT7
  ENST ID: ENST00000379091
  CDS Start-End: 166-1905
gaaatgactactgtccggggcccgaggtgctgcctcgcacaatgcatcaaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagt

SEQ ID NO: 200941 - DNA, 10132 bp, Homo sapiens
  Payload ID: 19661
  Gene Name: zinc finger and BTB domain containing 10
  Uniprot ID: Q96DT7
  ENST ID: ENST00000430430
  CDS Start-End: 780-3395
aaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggtagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagtgcccacacttgccgttgtgctgtatacatgattttaccttaatcctctataaggtaggtgctaattgtctccattttatagatgaggaaaggctcagagaaattcagaaacttggctaatttaacacagctgtgacagagctcgaatttgaccacgtctgattctgaagcccatactctttcagggaggctctattgctgcctcattaaacaactcttgtagaatttcagctcttaatggagtctatggattatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagtttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgtaatttacatttgtgcataatcttggaaatgggttgaaaagcaaaggtaaactgcttcatcccatgttgtatatttgtggactgattgactacaagtgatgtgatgttataaatttgaagtctttgaaactttattaatgtagagaaaacataactagctttttaggttatttcaaagttagtaatagagcaaaggaaatcagaactggccagatattcagacttgacttagaaaaacaggagtttgttgattttgtttggagaagggcacaataaaggggagcccacatagcattataatgcctagtatctttaaacatgtaaagagctatcatgaggcagaagaattaagaaactttatatgtttctaaggggtcatgattgggaccattggctcaagattgaaaatcggtttttaattatccaaagatgaaatggggctgcttcagaaaaaggtctaccactggagataacgctatgaaaagtgaaagagattacttaatcattttgacaaaggcagtattgaccagacatttctatttcagagttggatttgtgcttagttttttttaggtgttgggacccttgtagttgctttttattttgcttagtcaacaaacactaaaatgataaaatttggtatgtataagtactggacgaaggatgttttgacactaaaaaggacataatttaggaaattaagaatttagacaccaagtttggcttaatagaaaaagtcactatctgaacttctttctttttcaccacaaatcaccgcagaccagtgtttgggagcaggtgtaggaaattgaattattggatctatgtttaggtaagaaaactaaaggtacttcagaatttaggctatgacataactgtctttctgaagtttaaagaaagaaagtgaactatagaaatctattcagctaattaaagtgaatgaaaaatattacagattccataactgcatggcgccttacctgctattaatactgccgccttactgtcagccagatgattttttcccaccacggccagtcttaaatttggcaataagaaaaagctaatcttccaagtgtaagtaggtatgtgttagaatcttggtgaaagataaacacaagacagtcttcttggcgcaggtcctaacagttggtgagataatacataagatggtttcaggattattgtagaattatttaggttgaaagagactgtaagagactaatgaagcatacccagagaggttgctacagtgactccagtcagttttaggacccaggactcctgaacttcaatttcagtattatttttctgtaccaaactcattcaataaatacttgagattagggataagtttgaagttagaagattccagagtacactcaaatagtatttggcacatagcttgttgatcaaaagtatttactaagtgagtgacaaaaggcactagcaactttaaggattttgcctattagtatcatatggcatgtagctatcaagccagtttcgtttagttattttgtgttgccaagcatatgatacgtggtgtcacactgagcctttgggatcctttccctggatacataaccctagtagataatgttactgcaagatgtaatgaccaaatccaacctactgcaaatgttactatggaaatctcaatgcaaaagtagcctttgtgattttttttttaaaccgtctccataacagaacacttagaattattagccatttgctgcaaagtatttgttttaaaatgtctggcatatacaccactaacatttaaatgcccaacattcggtctatacgtgaaaaaactagaagaaaagccctgttggagttttgatgtagagtgcaataatacatcaataaaggtattttaaaatga

SEQ ID NO: 200942 - DNA, 5458 bp, Homo sapiens
  Payload ID: 19661
  Gene Name: zinc finger and BTB domain containing 10
  Uniprot ID: Q96DT7
  ENST ID: ENST00000455036
  CDS Start-End: 599-3214
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggt

SEQ ID NO: 200943 - DNA, 9878 bp, Homo sapiens
  Payload ID: 19661
  Gene Name: zinc finger and BTB domain containing 10
  Uniprot ID: Q96DT7
  ENST ID: ENST00000426744
  CDS Start-End: 599-3142
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagtgcccacacttgccgttgtgctgtatacatgattttaccttaatcctctataaggtaggtgctaattgtctccattttatagatgaggaaaggctcagagaaattcagaaacttggctaatttaacacagctgtgacagagctcgaatttgaccacgtctgattctgaagcccatactctttcagggaggctctattgctgcctcattaaacaactcttgtagaatttcagctcttaatggagtctatggattatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagtttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgtaatttacatttgtgcataatcttggaaatgggttgaaaagcaaaggtaaactgcttcatcccatgttgtatatttgtggactgattgactacaagtgatgtgatgttataaatttgaagtctttgaaactttattaatgtagagaaaacataactagctttttaggttatttcaaagttagtaatagagcaaaggaaatcagaactggccagatattcagacttgacttagaaaaacaggagtttgttgattttgtttggagaagggcacaataaaggggagcccacatagcattataatgcctagtatctttaaacatgtaaagagctatcatgaggcagaagaattaagaaactttatatgtttctaaggggtcatgattgggaccattggctcaagattgaaaatcggtttttaattatccaaagatgaaatggggctgcttcagaaaaaggtctaccactggagataacgctatgaaaagtgaaagagattacttaatcattttgacaaaggcagtattgaccagacatttctatttcagagttggatttgtgcttagttttttttaggtgttgggacccttgtagttgctttttattttgcttagtcaacaaacactaaaatgataaaatttggtatgtataagtactggacgaaggatgttttgacactaaaaaggacataatttaggaaattaagaatttagacaccaagtttggcttaatagaaaaagtcactatctgaacttctttctttttcaccacaaatcaccgcagaccagtgtttgggagcaggtgtaggaaattgaattattggatctatgtttaggtaagaaaactaaaggtacttcagaatttaggctatgacataactgtctttctgaagtttaaagaaagaaagtgaactatagaaatctattcagctaattaaagtgaatgaaaaatattacagattccataactgcatggcgccttacctgctattaatactgccgccttactgtcagccagatgattttttcccaccacggccagtcttaaatttggcaataagaaaaagctaatcttccaagtgtaagtaggtatgtgttagaatcttggtgaaagataaacacaagacagtcttcttggcgcaggtcctaacagttggtgagataatacataagatggtttcaggattattgtagaattatttaggttgaaagagactgtaagagactaatgaagcatacccagagaggttgctacagtgactccagtcagttttaggacccaggactcctgaacttcaatttcagtattatttttctgtaccaaactcattcaataaatacttgagattagggataagtttgaagttagaagattccagagtacactcaaatagtatttggcacatagcttgttgatcaaaagtatttactaagtgagtgacaaaaggcactagcaactttaaggattttgcctattagtatcatatggcatgtagctatcaagccagtttcgtttagttattttgtgttgccaagcatatgatacgtggtgtcacactgagcctttgggatcctttccctggatacataaccctagtagataatgttactgcaagatgtaatgaccaaatccaacctactgcaaatgttactatggaaatctcaatgcaaaagtagcctttgtgattttttttttaaaccgtctccataacagaacacttagaattattagccatttgctgcaaagtatttgttttaaaatgtctggcatatacaccactaacatttaaatgcccaacattcggtctatacgtgaaaaaactagaagaaaagccctgttggagttttgatgtagagtgcaataatacatcaataaaggtattttaaaatg

SEQ ID NO: 200944 - DNA, 2833 bp, Homo sapiens
  Payload ID: 19661
  Gene Name: zinc finger and BTB domain containing 10
  Uniprot ID: Q96DT7
  ENST ID: ENST00000610895
  CDS Start-End: 130-2226
ccgagcagtttagcgtgcctctcaccctcagcgcctgcgaagccggcggcggcgtcgggactcctcggcgcgcggaggaaggatatctgtgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggca

SEQ ID NO: 200945 - DNA, 6020 bp, Homo sapiens
  Payload ID: 19662
  Gene Name: zinc finger and BTB domain containing 11
  Uniprot ID: O95625
  ENST ID: ENST00000312938
  CDS Start-End: 582-3743
ttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagtccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcatgaactttggagttgagcttgttactattttcagttcataaatcagttgttacttgatgtgttattaagttaatttatttttaaagggaaaggaaataaaacactaaaaaataacgattggaggaacacaatattaaaacttcttactcttacatataattgatatggacaagaggcaaggaaataatgggtagaagagggcagttccccagcaaaagcctggaaacccatggccctaaatgggaacaggcattcctgttttcatgcccaaatgttgccttttggcccaccacgccctcctatcctgtatccatataaaccctaaaccccaggctccatgagcagaagagtgttgcggcagaggagagaagagaggagcatctaaacgtccagaggagttcagctggggacggttggagaggagatcatcttcccactccatcccctttccagctccccatccatcctgctgagagccacctttatccagcaataaaatcccctgcatttaccatccttcaatttgtccatgtgacctgattcttcctggacgc

SEQ ID NO: 200946 - DNA, 2115 bp, Homo sapiens
  Payload ID: 19662
  Gene Name: zinc finger and BTB domain containing 11
  ENST ID: ENST00000461821
  CDS Start-End: 205-852
cccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgtaagtggtactctccagtcagctttaagatttgtaactagtgtactagtatttgcagccttggtgacttatttttctcaaaccactaagactgcttattgaataagacaaaatggcagtgtactgtgttatataagctgaactgcctcttcatttatcataaatgttcctgttattttttcagaatgaacttaataattacctgttggtttgttgttaattatcctccctcccttcttttgtgatgatatattggtacaagtagacagatttacatttctggaagcagtctctgagtttacgccccaaggtaaaattaatctggccaggtctttgtttttcacctgcatcagtttcatacatcatcatatttctgattagtaagaagaggcagccagaagtgagatacagattttcattaggtgaggtagaatgaacatggcagaaaataggataggacaacatatctttttatttaaatacataggtaacaaagaaaatatcaaattattcatacctggtaaaaggtaatatgtaatgtgtcttgttttaaagcttgttaagggtaaaaaatacaggtaatatgttactcttgctctcaaacttattttgacaggttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtaagggttttgtattactcttgctttttgtttgtaatgacattctagaagagggggatatgtatgtcttccacacacggactttatgccaaagtaagagaagcccactaacaacagtagactaagctgtactgaaaaggttctttttagcaagatttctgtggtagagttatggaaaagggtgtcatttcctttcactacgtcttaagtgagacaattatagcagaaaaagaatttctaggatttaaactgttaaaaacagtttgagtgaaatccataagtgcaacaaaattattacattaaatgaatatgttatttaaaaattgattgtttaagctaggtgtggtggtgcccgcctgtagtcccacctacttgggaggctgggatgtgaggatctgcttaaggtcaggagttccaggctgtggtgtgtcattgtacctgtgaatacccactgctctccagacggggcaatataacaagaccctgcctctaaaaataaaaagcaaataaaaattga

SEQ ID NO: 200947 - DNA, 1877 bp, Homo sapiens
  Payload ID: 19663
  Gene Name: zinc finger and BTB domain containing 12
  Uniprot ID: Q9Y330
  ENST ID: ENST00000375525
  CDS Start-End: 179-1558
cgcccacgcggagccggccccgcgcgcgcgcgcgtgtcccgtgcatccccgcgcctgcgcgctgcccaggccctgcccgtgtgtgggggtcgctgccggccccgggggggggtggggaaaataagggattaaaaaaacagcgcgcggaaccgggccagggttgcccacccccgccacaatggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcacgaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaa

SEQ ID NO: 200948 - DNA, 1875 bp, Homo sapiens
  Payload ID: 19663
  Gene Name: zinc finger and BTB domain containing 12
  Uniprot ID: Q9Y330
  ENST ID: ENST00000375527
  CDS Start-End: 177-1556
cgcccacgcggagccggccccgcgcgcgcgcgcgtcccgtgcatccccgcgcctgcgcgctgcccaggccctgcccgtgtgtgggggtcgctgccggccccgggggggggtggggaaaataagggattaaaaaaacagcgcgcggaaccgggccagggttgcccacccccgccacaatggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcaccaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaa

SEQ ID NO: 200949 - DNA, 1875 bp, Homo sapiens; identical to SEQ ID NO: 200948
  Payload ID: 19663
  Gene Name: zinc finger and BTB domain containing 12
  Uniprot ID: Q9Y330
  ENST ID: ENST00000458242
  CDS Start-End: 177-1556

SEQ ID NO: 200950 - DNA, 1875 bp, Homo sapiens
  Payload ID: 19663
  Gene Name: zinc finger and BTB domain containing 12
  Uniprot ID: Q9Y330
  ENST ID: ENST00000432044
  CDS Start-End: 177-1556
cgcccacgcggagccggccccgcgcgcgcgcgcgtcccgtgcatccccgcgcctgcgcgctgcccaggccctgcccgtgtgtgggggtcgctgccgaccccgggggggggtggggaaaataagggattaaaaaaacagcgcgcggaaccgggccagggttgcccacccccgccacaatggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcaccaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaa

SEQ ID NO: 200951 - DNA, 1875 bp, Homo sapiens; identical to SEQ ID NO: 200948
  Payload ID: 19663
  Gene Name: zinc finger and BTB domain containing 12
  Uniprot ID: Q9Y330
  ENST ID: ENST00000441555
  CDS Start-End: 177-1556

SEQ ID NO: 200952 - DNA, 1380 bp, Homo sapiens
  Payload ID: 19663
  Gene Name: zinc finger and BTB domain containing 12
  Uniprot ID: Q9Y330
  ENST ID: ENST00000611032
  CDS Start-End: 1-1380
atggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcacgaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctag

SEQ ID NO: 200953 - DNA, 3528 bp, Homo sapiens
  Payload ID: 19664
  Gene Name: zinc finger and BTB domain containing 14
  Uniprot ID: O43829
  ENST ID: ENST00000357006
  CDS Start-End: 340-1689
gtgttcacggccggctagacattctgtgctcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgcccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatca

SEQ ID NO: 200954 - DNA, 1814 bp, Homo sapiens
  Payload ID: 19664
  Gene Name: zinc finger and BTB domain containing 14
  Uniprot ID: O43829
  ENST ID: ENST00000400143
  CDS Start-End: 465-1814
gtagtctccaacgaaagcgtcggcaagggcccggattaaccctttctttgctcgcccacttagagacccggtcgggttccgtgcctgcgcaagccggcggcgcgccttccccccagcccgcaccgcgcatgcacgggaaggggggggcggtgggggtgttcacggccggctagacattctgtgctcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctag

SEQ ID NO: 200955 - DNA, 442 bp, Homo sapiens
  Payload ID: 19664
  Gene Name: zinc finger and BTB domain containing 14
  ENST ID: ENST00000578327
  CDS Start-End: 136-442
ggggaggcggctgcagctgcttatgatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaag

SEQ ID NO: 200956 - DNA, 649 bp, Homo sapiens
  Payload ID: 19664
  Gene Name: zinc finger and BTB domain containing 14
  ENST ID: ENST00000582135
  CDS Start-End: 154-649
tctaaggcggcgcggcattgctgtccggcctcctgcatctcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaa

SEQ ID NO: 200957 - DNA, 825 bp, Homo sapiens
  Payload ID: 19664
  Gene Name: zinc finger and BTB domain containing 14
  ENST ID: ENST00000582388
  CDS Start-End: 163-825
ggggcaccagccagctccaggatgtgcggcggccgccagcggcgcggcgcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaa

SEQ ID NO: 200958 - DNA, 3350 bp, Homo sapiens
  Payload ID: 19664
  Gene Name: zinc finger and BTB domain containing 14
  Uniprot ID: O43829
  ENST ID: ENST00000615385
  CDS Start-End: 163-1512
ggggcaccagccagctccaggatgtgcggcggccgccagcggcgcggcgcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgcccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatc

SEQ ID NO: 200959 - DNA, 3341 bp, Homo sapiens
  Payload ID: 19664
  Gene Name: zinc finger and BTB domain containing 14
  Uniprot ID: O43829
  ENST ID: ENST00000614697
  CDS Start-End: 154-1503
tctaaggcggcgcggcattgctgtccggcctcctgcatctcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgcccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatc

SEQ ID NO: 200960 - DNA, 2523 bp, Homo sapiens
  Payload ID: 19665
  Gene Name: zinc finger and BTB domain containing 16
  Uniprot ID: Q05516
  ENST ID: ENST00000335953
  CDS Start-End: 381-2402
gggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaa

SEQ ID NO: 200961 - DNA, 2287 bp, Homo sapiens
  Payload ID: 19665
  Gene Name: zinc finger and BTB domain containing 16
  Uniprot ID: Q05516
  ENST ID: ENST00000392996
  CDS Start-End: 169-2190
agcgctgcgggccctcctcggctctcggcgggaccggcggtgacaccggagctcgccgtgcgctcccggccgctctcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaa

SEQ ID NO: 200962 - DNA, 773 bp, Homo sapiens
  Payload ID: 19665
  Gene Name: zinc finger and BTB domain containing 16
  ENST ID: ENST00000544220
  CDS Start-End: 428-773
agcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgttctcagaaaccccgatgtctgcgggaaagcacgcggtggctcggctcggctgaatgctcatcccaaccttgacggcctccgtccccaccccggggcgggcagcaaaaatgtcttgaccagccgtcctgtgaatcctttctgcgtgagcttggtggctcctgaactgatagagctccttctgggggtggagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggagg

SEQ ID NO: 200963 - DNA, 572 bp, Homo sapiens
  Payload ID: 19665
  Gene Name: zinc finger and BTB domain containing 16
  ENST ID: ENST00000535700
  CDS Start-End: 129-572
tcttatgtatgcggaccggtgcgcgggcgcaagataagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgc

SEQ ID NO: 200964 - DNA, 757 bp, Homo sapiens
  Payload ID: 19665
  Gene Name: zinc finger and BTB domain containing 16
  ENST ID: ENST00000539918
  CDS Start-End: 1-167
atggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacagggtcttctagcataacctttgttcctgttggcaacacttcattttggactgtcaagatgcatttcctgagatgtgagatgtcatgaccctgtgtttggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggaga

SEQ ID NO: 200965 - DNA, 2770 bp, Homo sapiens
  Payload ID: 19666
  Gene Name: zinc finger and BTB domain containing 17
  Uniprot ID: Q13105
  ENST ID: ENST00000375733
  CDS Start-End: 240-2672
atgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacaggccctgcgactctgcccgcagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttct

SEQ ID NO: 200966 - DNA, 2745 bp, Homo sapiens
  Payload ID: 19666
  Gene Name: zinc finger and BTB domain containing 17
  Uniprot ID: Q13105
  ENST ID: ENST00000375743
  CDS Start-End: 234-2645
cggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 200967 - DNA, 731 bp, Homo sapiens
  Payload ID: 19666
  Gene Name: zinc finger and BTB domain containing 17
  ENST ID: ENST00000440560
  CDS Start-End: 1-631
gtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacaggccctgcgactctgcccgcagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 200968 - DNA, 722 bp, Homo sapiens
  Payload ID: 19666
  Gene Name: zinc finger and BTB domain containing 17
  ENST ID: ENST00000444358
  CDS Start-End: 1-722
gagaagccctaccagtgcgactactgcggccgctccttctccgaccccacttccaagatgcgccacctggagacccacgacacggacaaggagcacaagtgcccacactgcgacaagaagttcaaccagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtggga

SEQ ID NO: 200969 - DNA, 2511 bp, Homo sapiens
  Payload ID: 19666
  Gene Name: zinc finger and BTB domain containing 17
  Uniprot ID: Q13105
  ENST ID: ENST00000537142
  CDS Start-End: 248-2413
aacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggtctgccctgttccatctccaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttct

SEQ ID NO: 200970 - DNA, 3851 bp, Homo sapiens
  Payload ID: 19667
  Gene Name: zinc finger and BTB domain containing 18
  Uniprot ID: Q99592
  ENST ID: ENST00000358704
  CDS Start-End: 150-1745
agtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaa

SEQ ID NO: 200971 - DNA, 3740 bp, Homo sapiens
  Payload ID: 19667
  Gene Name: zinc finger and BTB domain containing 18
  Uniprot ID: Q99592
  ENST ID: ENST00000622512
  CDS Start-End: 70-1638
gaggaggcggaggacgcggcggcggcggggacgcggtgacttagggccgctccgtgttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactg

SEQ ID NO: 200972 - DNA, 3090 bp, Homo sapiens
  Payload ID: 19668
  Gene Name: zinc finger and BTB domain containing 2
  Uniprot ID: Q8N680
  ENST ID: ENST00000325144
  CDS Start-End: 142-1686
accgaccgcggcggcagcagcagcagcagcagcgagaggcagaggcggcggcggcggggaggacagcacggccgaggctgcccagaggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgtttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgag

SEQ ID NO: 200973 - DNA, 2956 bp, Homo sapiens
  Payload ID: 19669
  Gene Name: zinc finger and BTB domain containing 20
  Uniprot ID: Q9HC78
  ENST ID: ENST00000357258
  CDS Start-End: 615-2621
ggggcggggggaagtttaggagttgaggaaagaagattaaagagcgcgaggagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaa

SEQ ID NO: 200974 - DNA, 3323 bp, Homo sapiens
  Payload ID: 19669
  Gene Name: zinc finger and BTB domain containing 20
  Uniprot ID: Q9HC78
  ENST ID: ENST00000393785
  CDS Start-End: 419-2425
acttgttgcttacggtacagtccagcatgagctggaaatgtaggaacctcagcctcccgagcagaaagaatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgc

SEQ ID NO: 200975 - DNA, 2816 bp, Homo sapiens
  Payload ID: 19669
  Gene Name: zinc finger and BTB domain containing 20
  Uniprot ID: Q9HC78
  ENST ID: ENST00000464560
  CDS Start-End: 489-2495
acatttcaaaaaaaatacatagactgatgtttcagacttgtgcagcataagcctacagggtacgaagaatgaactctgagaatgtttggagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaa

SEQ ID NO: 200976 - DNA, 2800 bp, Homo sapiens
  Payload ID: 19669
  Gene Name: zinc finger and BTB domain containing 20
  Uniprot ID: Q9HC78
  ENST ID: ENST00000481632
  CDS Start-End: 441-2447
gcagggagcttaacagccaggcctggacaccctcaagagactgtgtgctgattctcagtcgtcactccttggatcaggaaccatagtcctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaa

SEQ ID NO: 200977 - DNA, 2757 bp, Homo sapiens
  Payload ID: 19669
  Gene Name: zinc finger and BTB domain containing 20
  Uniprot ID: Q9HC78
  ENST ID: ENST00000474710
  CDS Start-End: 180-2405
ttgggaaacagcccagtggtataaggatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaa

SEQ ID NO: 200978 - DNA, 551 bp, Homo sapiens
  Payload ID: 19669
  Gene Name: zinc finger and BTB domain containing 20
  ENST ID: ENST00000482689
  CDS Start-End: 494-551
actcagaagagacacagacaggagagaggaggaggggtggggggagagagagagaatcaatatcaagaatagaaggagctccgaagccattttttttttaaagaagtatcgggacttgggagagggtgacaaagaaggtttttcaaagaggcagtggaggaggttctaataaatttggaaggaaacagttccctgtcttgggaaaaggagaactcctgactgattagcattcacaccagatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatg

SEQ ID NO: 200979 - DNA, 3133 bp, Homo sapiens
  Payload ID: 19669
  Gene Name: zinc finger and BTB domain containing 20
  Uniprot ID: Q9HC78
  ENST ID: ENST00000471418
  CDS Start-End: 774-2780
atctagcctcccagcctcactgcattatttgtgaaaatggccagtgtgaggaattattaattaaagctaacaaatcaccctgacaagctgtgccctggcatggctgaaggttgattggcgaaagtcttctcctttggagaaaagactttttgtgctcgtgacgcagtcagggacggattattgaatatgcaagttagaagaaaaatcacaggacaagcaaattgagtatttactggcaaataattgcactcttaagctgtggctctcttcctaaattcttaacattctcgagggttagaaagaaacacagaaaaatgcatcggtacagagtacatttcaaaaaaaatacatagactgatgtttcagacttgtgcagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaa

SEQ ID NO: 200980 - DNA, 3740 bp, Homo sapiens
  Payload ID: 19669
  Gene Name: zinc finger and BTB domain containing 20
  Uniprot ID: Q9HC78
  ENST ID: ENST00000462705
  CDS Start-End: 823-2829
ggaattttatctctgctcacagtctacattacaacattagttcattctgggcactttagcttccttgaatctccagttgatctcacacccatgcctatgatattcttctcctggttaatcaagaattctctatttctgctccgtcatccatgccactacaaataaaaagaagtgttaagaattgcctttgggactctgaaggctgaagaattgatgaattgcaagtttgtgccccatagctgcacagcctatgtctaagcacagctcatcttcacaaactgaagtggatcttgatttctggaaatgtccaaataatgacaacaaccccatggaggtggatacatcagagtcagctggaggtggtcagaattatttgcaatgtttgggaaagcacctaccaaggcttcctattacctatttcacagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgcaaaaaaaaaaaaa

SEQ ID NO: 200981 - DNA, 587 bp, Homo sapiens
  Payload ID: 19669
  Gene Name: zinc finger and BTB domain containing 20
  ENST ID: ENST00000470311
  CDS Start-End: 415-587
aaggtttttcaaagaggcagtggaggaggttctaataaatttggaaggaaacagttccctgtcttgggaaaaggagaactcctgactgattagcattcacaccagatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccagga

SEQ ID NO: 200982 - DNA, 7449 bp, Homo sapiens
  Payload ID: 19670
  Gene Name: zinc finger and BTB domain containing 21
  Uniprot ID: Q9ULJ3
  ENST ID: ENST00000310826
  CDS Start-End: 185-3385
gtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 200983 - DNA, 555 bp, Homo sapiens
  Payload ID: 19670
  Gene Name: zinc finger and BTB domain containing 21
  ENST ID: ENST00000398497
  CDS Start-End: 408-555
tgggatgacgtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgatctgaaaaatacactgaggagaaagtacacccggcaacaaagctcgccttatctgacagcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctg

SEQ ID NO: 200984 - DNA, 5806 bp, Homo sapiens
  Payload ID: 19670
  Gene Name: zinc finger and BTB domain containing 21
  Uniprot ID: Q9ULJ3
  ENST ID: ENST00000398499
  CDS Start-End: 348-3548
tgggatgacgtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaaca

SEQ ID NO: 200985 - DNA, 6846 bp, Homo sapiens
  Payload ID: 19670
  Gene Name: zinc finger and BTB domain containing 21
  Uniprot ID: Q9ULJ3
  ENST ID: ENST00000398505
  CDS Start-End: 185-2782
gtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttgagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 200986 - DNA, 5608 bp, Homo sapiens
  Payload ID: 19670
  Gene Name: zinc finger and BTB domain containing 21
  Uniprot ID: Q9ULJ3
  ENST ID: ENST00000398511
  CDS Start-End: 150-3350
gcgatgacctcatccctggtgtgggatgacgtcaaattcaagatggatggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaaca

SEQ ID NO: 200987 - DNA, 607 bp, Homo sapiens
  Payload ID: 19670
  Gene Name: zinc finger and BTB domain containing 21
  ENST ID: ENST00000425521
  CDS Start-End: 252-607
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttc

SEQ ID NO: 200988 - DNA, 463 bp, Homo sapiens
  Payload ID: 19670
  Gene Name: zinc finger and BTB domain containing 21
  ENST ID: ENST00000449949
  CDS Start-End: 316-463
gtcaaattcaagatggatggaatcacagcggcagcggcggctgcggcgcgcgcgagccgagtgtgagcggaaaggggcccggcgtctgcctcgagactgaagaccgagcccccgcagaccttgtctgggacttcccggcggtcccgcagagcatagcaccctccgccggccaggagccctgctgctcggccggcgaccgtctccccgcttggaggagcccccttccccccgtccgagaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctg

SEQ ID NO: 200989 - DNA, 2651 bp, Homo sapiens
  Payload ID: 19671
  Gene Name: zinc finger and BTB domain containing 22
  Uniprot ID: O15209
  ENST ID: ENST00000383196
  CDS Start-End: 153-2057
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccagcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtttctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 200990 - DNA, 2651 bp, Homo sapiens
  Payload ID: 19671
  Gene Name: zinc finger and BTB domain containing 22
  Uniprot ID: O15209
  ENST ID: ENST00000418540
  CDS Start-End: 153-2057
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccagcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 200991 - DNA, 581 bp, Homo sapiens
  Payload ID: 19671
  Gene Name: zinc finger and BTB domain containing 22
  ENST ID: ENST00000448500
  CDS Start-End: 134-581
aataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaag

SEQ ID NO: 200992 - DNA, 2651 bp, Homo sapiens; identical to SEQ ID NO: 200990
  Payload ID: 19671
  Gene Name: zinc finger and BTB domain containing 22
  Uniprot ID: O15209
  ENST ID: ENST00000416097
  CDS Start-End: 153-2057

SEQ ID NO: 200993 - DNA, 581 bp, Homo sapiens; identical to SEQ ID NO: 200991
  Payload ID: 19671
  Gene Name: zinc finger and BTB domain containing 22
  ENST ID: ENST00000454866
  CDS Start-End: 134-581

SEQ ID NO: 200994 - DNA, 2651 bp, Homo sapiens
  Payload ID: 19671
  Gene Name: zinc finger and BTB domain containing 22
  Uniprot ID: O15209
  ENST ID: ENST00000445320
  CDS Start-End: 153-2057
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 200995 - DNA, 581 bp, Homo sapiens; identical to SEQ ID NO: 200991
  Payload ID: 19671
  Gene Name: zinc finger and BTB domain containing 22
  ENST ID: ENST00000436352
  CDS Start-End: 134-581

SEQ ID NO: 200996 - DNA, 2645 bp, Homo sapiens
  Payload ID: 19671
  Gene Name: zinc finger and BTB domain containing 22
  Uniprot ID: O15209
  ENST ID: ENST00000418724
  CDS Start-End: 135-2039
gaataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccg

SEQ ID NO: 200997 - DNA, 2651 bp, Homo sapiens; identical to SEQ ID NO: 200994
  Payload ID: 19671
  Gene Name: zinc finger and BTB domain containing 22
  Uniprot ID: O15209
  ENST ID: ENST00000431845
  CDS Start-End: 153-2057

SEQ ID NO: 200998 - DNA, 581 bp, Homo sapiens; identical to SEQ ID NO: 200991
  Payload ID: 19671
  Gene Name: zinc finger and BTB domain containing 22
  ENST ID: ENST00000426244
  CDS Start-End: 134-581

SEQ ID NO: 200999 - DNA, 581 bp, Homo sapiens; identical to SEQ ID NO: 200991
  Payload ID: 19671
  Gene Name: zinc finger and BTB domain containing 22
  ENST ID: ENST00000441117
  CDS Start-End: 134-581

SEQ ID NO: 201000 - DNA, 5519 bp, Homo sapiens
  Payload ID: 19672
  Gene Name: zinc finger and BTB domain containing 24
  Uniprot ID: O43167
  ENST ID: ENST00000230122
  CDS Start-End: 169-2262
cgcgcttccgggttggctgtggctgtggctgcggcggcggcgcaggagcagaaaccggtgcggcgcagaagccccagaggcgggcggggcggagcggagggccagcgggccccggcgtgggtctcccgccaggccgccggatttaacccttagtggcttctgaagaaaatggcagaaacatcgccagagccttctgggcagcttgttgtacactcagacgctcacagtgacactgtgctggccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcaggaggagaaatcagaactggctgcagaggaagaaatacagttaagagtgaacaattcagttcagaatagacaaaactttgtggttaaaggagacagtggtgtactgaatgagcaaattgcagcaaaagaaaaggaagaatcggagcctacttgtgagccaagtagagaggaggaaatgccagttgaaaaagatgagaactatgatcccaagaccgaggatggccaggcaagccagagtcgatacagcaagcggaggatttggagatccgtcaaacttaaagattacaaacttgttggggatcaagaggaccatggttcagccaagaggatctgtggaaggagaaagcgccctggaggccctgaggcccgctgtaaagactgtggcaaggtctttaagtacaatcactttttagcaatccaccagaggagccacacaggggagcgacctttcaaatgtaatgagtgtggaaaaggctttgcccagaagcactcgctacaggtccacaccaggatgcacacaggcgagcggccgtacacctgcaccgtgtgcagcaaggctctgaccaccaagcactcactgctggagcacatgagcctgcactcaggacagaagtcttttacctgtgatcaatgcggaaaatatttcagccagaacagacagctaaagagccattaccgagttcatacaggccactcattaccggaatgcaaagactgccatcgcaaattcatggatgtgtctcagctaaagaaacatctgcgaacacacacaggtgagaagccatttacttgtgaaatctgtggcaaatctttcacagcaaagagttctcttcagacccacatcagaatccatcgaggagaaaagccatactcctgtggcatttgtggcaaatccttctctgactccagtgccaaaaggagacactgcattctacacactggcaagaagcctttctcctgccctgagtgtaacttacagtttgctcgcttagacaacttgaaggctcacttgaaaattcatagcaaggagaagcatgcttcagatgccagcagcatttctggcagtagtaatacagaagaggtcaggaatattcttcagctacagccatatcaactctctacctcgggagagcaggaaattcagcttctcgtaaccgattctgtacataacatcaatttcatgcccggtcctagccagggaatcagcattgtgactgcagagagttcccaaaacatgactgcagaccaggctgctaatcttaccctgctcacgcagcagccagagcaactgcagaatttaattctttcagctcaacaggagcaaacagaacacattcagagcctcaatatgattgaaagccagatggggccctcacaaacagagccagtgcacgtgatcactctgtccaaggaaacactggaacatcttcatgcccatcaagagcaaacagaggagctccatttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaaggtactgatttgtattgagcatttcaatattattgaatggttttcattttaatctgcaatgtctcataaagactcgggtagtttttctttgggggcattgatctcagtttttctgtaaggtttaaatgttcacagccataggttatggtcttgccaacctccccagttatgtttttttgttttctaggacaaagggagtcattttggttgaactgggcagaatggtttgttctattttcttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttccatcaattgttttgttttagacatccttgatttctccctaaatcaaataagttatttggaggttagagtaatagagaattcttcaggtttgagagaagataaaaacattttggttgcatatttgctaagctatattttattatatgtaattcacaaaacttccaaaatgatatatatcttatatgtatcaaccaaactaatgttaaatcaggcctgactagagcaaagataacaattttttacaaacactgttaagccctaagtattatttcaggttctcgtttaaactgtttaattttattcttaaaacacaaagtttttaccaacttttcaaagcccaccaatccacattttctccaggaaattaaatatttaagtaagtgagtgtttactcactctggatagctaggtgattattcagaaaatacggttacatagctatttataagtcaagtttcactggctctataacagtctacctctacactaagagaactataacatgaacaacataggtcactttaaatgttctagtagcaacttttaaaaacataaaaagaagcaggtgaaaatgttaataaaagtttatttaatccaacatttgccaaatatttcaacatataaaaatatattagtgagacattttacattctctttttcatactaagctttcgaaatctggtgtgtattttacactttctgcacatctccatttggatgctaatgttcattggacatacttgatctgtatttagatttcatacaacttacagttgaaaacagattctcatatcaagtagctaagacaaaagtttttttcaagaattgaaataagtatcagtttaaaaatttatattaaatttattaaaattaaaatccagttccttgttgcatgggacacagtgcaaatgcttgataagcacatgtggctagtggctgctatattggacagcatgggccacctgtttctaacttgagcatcagtcctagctatgcctgaattatttgaccagctgtcaaagagaaacaaggaaatgatagctttgttaatctagcctctttctttgtcccacatatacattctacccctttgaataaaaaagttcaatgacgccgggcgtggaggctcatgcctgtaatcccagcactttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagaatcacttgaacccaggaggcggaggctgcagtgagctgagatcacgccattgcactcaagcctggcgacagagcgagactccgtctcaaaaaaaaaagttaaatgacttgagtacccaaaagaaatgtcgtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgattggagctcttaccatcaaaatcagttattcaagtgcttgcccagtgcttcttgaaactcacctctactctgtattttctacagttggttcttgtgttataaatgttgtgagcaacagattaaatgatgctgaggaatgaaaaaa

SEQ ID NO: 201001 - DNA, 2094 bp, Homo sapiens
  Payload ID: 19673
  Gene Name: zinc finger and BTB domain containing 25
  Uniprot ID: P24278
  ENST ID: ENST00000394715
  CDS Start-End: 703-2010
aagtttctgcgtcgagctccgaggaggctggcgcaacccgcaccgcgggggccgtcgcggcggcggcggcttgaccacccctcttgcccctctcaaggcttgacccatcttatcaccgtcttctctggcactcagtatttggagtaatcagttgttaccagttgcggaggcagcgcatagcacaacgtagtacctggaacctgacggcacctagcatgtttcaacagttagcgcccgcatcaccccaagggattaaatttggcattctttctcttgagactcaagtcctggcagagctgttgatcctctcacaagattctgtcatagaagacaccaggcctgaagagcgtgatgtagctggagctagctacacctcttgatagctaagactccaaggctccagacaccttggtgattgcactctccaccatgccaggaccgcagtgccagtttaccccactcacctgtagagaatgtatccggcggaggtcattatatatacttggcttgattcaggttatggagaagtcaggcatggccactgtgtgggtttgatggtatttctaggtgagatggagtttcactcttgttgcccagactggagtgcaatgacacaatctcagctcaccacaacctctgcctcctgggttcaagcgattctcccgcctcagcctcccgagtagccgggattatagaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctc

SEQ ID NO: 201002 - DNA, 1440 bp, Homo sapiens
  Payload ID: 19673
  Gene Name: zinc finger and BTB domain containing 25
  ENST ID: ENST00000555220
  CDS Start-End: 735-995
aaagaaggtaactaatttgggaactagtctccgtaggggcttcgcctccgactcagggaggccgcacgcccgggacctgacgcgccggcaacaagcaggcggcctggcagccgcccgtcaccgggtcctcgcagcgcgtccgccgcgctccggctccccgcacggatcggcgcccctccggccccgcactccgccaggcccgcggcccgtcgccctccggcctgggccaaagttgcgcaaatagccccacaactggcaaatacttaccggccgcaacaggaaccagagctgcggagattttagggagtttaaggcaaatcagccgcgggaaaggcgggcgaaggcgaaggggccgcgagctgcagtggcggcggcgcgcggcgctcggcgctcgggctgggctgcgcggagaggctctggctctgccagggactgtgctgcaacaaaggacttccgctgccgcacagccgcgcctgccgcaccgcactgagccggccccgcttacgcggcgactccgggtctgcccaccagttcgctgcggcgtccgccagccttcccctccctctcgcccgcccacccactctgccgctggctgctaggggcacccgcggtcgcctgtttgttgcaacaagtttctgcgtcgagctccgaggaggctggcgcaacccgcaccgcgggggccgtcgcggcggcggcggcttgaccacccctcttgcccctctcaaggaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagacagcaaatcacccaccttgaggtcataaaggagctggaagctgctgggtgcttgtgctgctctctggacggcctgagccagggctaaggcacccttgcccccttctgcccagtgagtgcacttcacggcatcaaaagccccatgttctctggaaaggcggctgatgaggtccagctcagactctgtatccgtcctataaaggaagcatttcatatcaaagcatggaaaatggctggagagacagaattgtcttctttttgccattaaacctcatgtgaattacccactgataaacgaacactaaccaagaaatttggcctgggtttgaatctcagctccgaaacttactagctggtgacttttggccagttacctaatctttatgtgcctcaatttccaccctggtaatacgcgaataatcacagcacttatttcattgggacgttatgagactcagatggtaaatccatgtaaaatacttggaaaattcccagcactccagaaggaatcagtaaatactagcatttaagaa

SEQ ID NO: 201003 - DNA, 565 bp, Homo sapiens
  Payload ID: 19673
  Gene Name: zinc finger and BTB domain containing 25
  ENST ID: ENST00000555424
  CDS Start-End: 1-285
atggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaaggaaaagaaaaatgagctgtaccatctgtggtcataaattccctcgaaagagccaattgttggaacacatgtatacacacaaagacagcaaatcacccaccttgaggtcataaaggagctggaagctgctgggtgcttgtgctgctctctggacggcctgagccagggctaaggcacccttgcccccttctgcccagtgagtgcacttcacggcatcaaaagccccatgttctctggaaaggcggctgatgaggtccagctcagactctgtatccgtcctataaaggaagcatttcatatcaaagcatggaaaatggctggagagacagaattgtcttctttttgccattaaacctcatgtgaattacccactgataaacgaacactaaccaa

SEQ ID NO: 201004 - DNA, 10372 bp, Homo sapiens
  Payload ID: 19673
  Gene Name: zinc finger and BTB domain containing 25
  Uniprot ID: P24278
  ENST ID: ENST00000608382
  CDS Start-End: 193-1500
ggcgcccctctttcccctgctaccagacacgcggtcacgtggggccatcgcgggctgccggcgcgggaagccgcgcgagaggcggccgaggggtgcgtgagccggcgccactgcttgcagtgcgcggcttgggagcccgcccctcctgcacggaggagtcggcctgccgccgcggcggcatctggaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctcaagtttcattgactttttttcttcacagcttatccatggttttaaggttgtatatattagatcttctcataagacatattaatatgtggctattaaaatgtaacattcaattactactgtgaacttttcacaaacgaaataacaatttagaaatcagaaatcaatgtagaaatatggaaaccttaaatagttatttatagaattctaagtttttccagttatagaatcagtaaaatcaaattgaatataaagtaaatgaaatctgttttaaagcatattctaaactatcacttctgcctacatttcacatgaattcactcctaccaggattatttttaaatattttcttccatataggaaattaatagttactttaatgcataactgtatgttatacatatgttataatgtataaaaatttattttaagatataccaaatcatgagtagttttattttttaactactagctccacaacatcttacctacatggcttctctttactttttaacattgagtatacctctttttttttttgagacagagtctctctgtgtcgcccaggctggggcgcagtggcgcgatctcggctgactgcaagctccgcctcccgggttcacgccattctcctgcctcagcctcctgagcagctgggactacaggcgcccgccaccacgcccagctaatttttttgtatttttttagtagagacggggtttcaccgtgttagccaggatggtctcgatctcctgacctcgtcatctgcccgccttggcctcccaaagtgctgggattacagatgtggtatatctcatttttaataaaaaaaacagttaaagggagaagagtcagagagacattaaaaaatatttaagaaacagtaagatatacacacatagataaataagcatgcagagacagagactgagctagaactgcattgactaaaaaccccagggttgttaacttggtctagagtgttttcttagacaccttaaaaagtaatttgagattttatgaccagaggtttacatgagttgaaagagaatgatgataaaatataaatcatgtttctaccctcagcgtcaggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctctataaatcaacttaactctcttttataatggtgacacttacaaagctaaaaccccaggaaaattaaagttgatgaaagaaataacagattccccggctctatatacctgggaaatagctggttaagcttcaccacaaaggatagatctaaattgtttctgaaatgtttaaatttcaaaccccgcatagtcaaggataataaaacagactcatctttttttgccctcttgttaaattctaagcttcacgggcatttgaatacatctaaaaaatttggtttgtgagccttagaatttaaccacttacaaaactcttgagctccctccacttctgaggacgtttcctgacacattcaacagcatcagcgtccaatcaggagggagctcaaagagtaatccagctaattctaaggacacaaaggttttctctaggtaaacagtttaggtaaattacaaagtggtaagtttttcttgaggattgaatgaagaaagctactggatattgtgtaaggcagttgagtttctgccttaaacaagtgagtaaaggctcctatggttaagactgatgtgtgttgagagcacatctaacttgataagatcaattgtattgggagtaattaaaacaaatgtatgttctttggggtcagaactttgtctaatcttaaacttttttctaccaattcacttaagcaactattgaaatttgtactgccctcaaaaatatcatctcattggaagaacacaagtattaacattgattttttgtattttaggctagttaagatatatttcctagccttcttcaattcaaattctattgttcttattaagataatttttctcctctatattcttccctgtttgcctactcattattattatttttttaatttaatttttttttaagatggagtttcacccttgttgcccaggctggagtgcaatggcgtgatctcggctcactgcaatctctgctgcctgggttcaagcgattctcctgccttagcctcccaagtagcttgggattacaggcatgcaccaccatacccagctaattttgtgtttttagcagagacagggtttcaccatcttggtcaggctggtctggaactcctgacctcaggtcatgcaccagcctcggcctcccatagtgctgggattacaggtgtgagccaccgtgccaggcccactcattattctttgacacaggaaatccttgtatatagctaaagggtggaggtagagttgtacatggttggttggataagacagcaagtgcctcagggcagagtttggataaatggtaagagtttgctagcagctgattggccgtgatagacaacactcatttaaagcagaaatatatctgttcgttgagagttaagaaaatagtggttaactgtatttctattcttatagttccttttaatattagaaattcaaagcaaatgctctttccttgttccttaaaacattcattctgtttaggaagtgggaaaatatcaacttcattttatagaaaaaaaatcccaaaagctgaattccagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcagcctcctgagcatgtgccaccatgcccagctaatttttgtatttttagtagagacagggtttcaccatgttggccaggatggtctcgagctcctgacctcatgatctgcctgcctcagattacaggcatgagccaccgcgcccgggtctgcaggcattttttaaagtaactgtcatatgcctaacactgtgccctgagtattattttttaaagacatgattgctcactgagaaaatttgctttgtattttaaaagttcttccagctaggccaggcgtggtggctcatgcttgtaatcccagcactttgggaggccgaggcgggcgggtcacgaggtcagaagatccagaccatcctggctaacacagtgaaaccgcgtctctactaaaaatacaaaaaattagccgggtgtggtggcacacacctgtaatcccagctactcgagaggctgaggcagtggaatagcttgaacccgggaggcagaggttgcagtgagcggagatcgcaccactgcactccagcctgggtgacagagcgagactccatctcaaaaaaaaaaaagttcttccagctaaaacctttattttttgactacatctccacaaaatggagctatactgttagccagtatcctaatagtatagtgcagtttgcataatgattaccaagcttgaaactggaaatgtcatatgcactttcgtgtgtatcaggcagatactaaacattttccccttgagtcagcttaaaatttttccttcttttgaaatctcacgcagttgttttctggagaaaaatagagactgttttagtatttgttcttattagcgtatcatcagaactcagcacagtctgccttataagaaaacaaaaaatttttttatttataactcttgagattgttacttcttgctctttctgatttcccatccgtaaagtgggtgtaagcaatacttacctcacaggggtgttgtgaggatttatattaaacgtgttaagttctctcagtattattgattaaaatcaaccatataaacgacatttattctgtagctagacctattaactttagtatttcagcctataaattctaaaatgttcttaaaagcagtaatgtactatctaatattcaataactaattgacagaactcattgttattttttacaaataactagaaacaatactgttgctagaattcctgttctactgtaatttaatcatcactgtttctttttagccttcagtaaggaggatactagttctttggcattattgggaataaaactttgtcaatttcagctttattgaaagttctcccaaatatattgtttttgtttacacaaaggaaaaggaacaaaaacaataaataaatacctttgtttttttttcttttttgagacggagtctcgctctgttgcccaggctggagtgcagtggtgcgatctcggctcactgcaacctccgcctcccaggttcaagcgattcttcttcctcagcctcccgagtagctggaactataggcacgcaccaccacacccagctaatttttgtatttttagtagagatggggtttcatcatgttggcaaggctggtttcgaactcctgaccttgtgatctgcctatctcagcctcccaaagtgctgggattacaggtatgggccactgggcccagcctatttttatttctttgatgtaggtgatctaaatagtagatgaggacaggaaatggggtgaaggtaataatagtattattagaaaagtcttcactgaaaattgaaggaaatacatattaatcgtggaaaaagatagtgtgaaaaatgtgtaatttcgttaacatttatttgtacaggcacattcttgatgttgtgagtcagatacttgataaatgtccattttttgtagtaattgatgtaaaaatgggccatgtgaagaattttcataatgtaatttgtgtctttgtatattttgaactacatatagatttgtggcacttaaattattaatttttgatttcttaagagtgaagtctgtaaatgatttctctctgctgtacttctgtgtttgtatggttggacattttgaaaactggtgagattgcacagtcccaaacctggatgtcttaaatacaaggaattacaaactgtgatttttgtcttgaagacctggaagaattcattgtgcttcagtatgtatttgtactgcacttgattaattagttaagtattggtctggtgcaattgacattaactgtcatcaactcctctattttgtgctaaataaagtcatttagtcagaatggatcaaatataaacttatactttaaaataaacttagattataaaaacttgttcaataaaaaagacccactgaaaaatcttcaaagtacatgtaacacatagctaatacaggagaccaaaatcaataatacattgtgtggctaaactcatccacctaatgtactgtgaatttgcttcagaaacattcttttagaaagttgtgtatctgccgggcatggtgcctcatgcctgtaatcccagcactttgggaggccaaggcccaggagtccgagaccagcctgggcaatatagtgagacctcatctctgccaaaaattttggccaggggcagtggctcacgcctgtaatcccagcactttgggaggtcgaggtgggcggatcaccagaggtcaggagttcaagatcagcctggctaacatggcgaaaccctgtctctactaaaaatacaaaaataagccaggtgtggtggtgcgcgtctgtagtcccagctacttgggaggctgagacagaatcatttgaacccgggagatggaggttgcagtgagccgagattgcgccattgcactccagcctgggcgacagagtgagactccgtctcaaaaaaaaaaaggcagggtgtggtggctcacacctgtaatcccagcactttgggaggccaaggcgggcggattatgaagttaggagatcgagaccatcctggacaacatggtgaaaccctgtctctagtaaaacacaaaaaattagctgggtgtggtggcacgtgcctgcagtcccagctactaggggggcagaggcagaggaattgcttgaacccgggaggcggaggttgcagtgagccgagattgcgccactgcactccagcctggcgacagagcaagaaacaatgaatttcatatattttatcaagacaaattaatgtgacttaatcaaaaacaagtttattagcttagcttatagaatgtgttcttattttacatcagtgtttgccaaatgttgtgttcctagtgttgaggcaagtagtctttgtactgggtaacattttggaggtgtgatgcaaaaatgcatttgtggacctaattcttaccgaccataatctgtgttaatcgaaaattgacgtcctaatcaaatgctttccaactgctgtctctggaaagaaaggtagtatttcgtcatttcccagaagtttcttgctttgcttcttcttttttttttttttttttttttttgagatggagtcttgctctgttgcccaggctggagtacagtggagtgatctcggctcactgcaaccttcacatcccaggttcaagctattctcctgcctcagcctcccgagtagctgagattacaggttcccaccactacactcggctaattttttgtatttctagtagagacggagtttcaccatgttggccaggctggtctcgaactcctgaccttgtgattcacctgcctcagcctcccaaagtgctgggattacaggcgtgagccaccgcgcccagctgcttctttcttctctatttacagtctactgtatcgccttttgcccccagtaacatgatccacaatagtagttctcaactgaggtatattagtcaggattctccagaaaaagaaagaaacaacaggtagaactgagagagagaaagagattgattgattataaggaataggttcatgtaattatggaggctgagaagtcccaagatctgcagttgggaggctgagaggctggggagtcagtgatgttccaatctgaatttgaagacctgagaaccaggagagcttatggcataagttccagtccaaaagctggcaggcttgaaactcaagaagagctgatgtttccatttgggtccaaagggaagaaaagaccgataattgcagctcaagcagtcaggccagagaaagtctctttttttattatattctggccttcaactgatggaatgagagccacccacatcagggagggtgatcttctttacgcagtctactgattcagattttgtctccctccagaacaccctcacggacacacccagaataatgtttgactaactattggggcagcccatggcccagtcatttggacacataaaattaaacattacacagggctatccccccccatagagacatttgacgatgtggagatgtttttggttgtcacagttgggtgggcgatgagggaggctgctgctggcatctagtaggtggaggccagggatgctgctaaacatctcagtgcagaggacagcctcccgcaatacagaatatgtacctcaaaatgtcattagagctgaggttgaccaacccttctgagaccttaaagtaagttttgtgatggctgtcaggaataaaagaatacaaagaaacccaatttgggggatttctattctagtcatgtttagagcaagtattggagtatgagatgtgttcagaattaaattctatttgtattatccttgatcccagcttttaaaagataaaaatgtgattattagaaataaaaggaaaaaatgtgattattaaaaatcagagatgtattaatcagcaagacagttttgaatctattcatataatgtttgaactaaataattgtctccccaaagaggtctcttcatgaaattgagattgtaggttataatttctgtgaatttttaatctggccaaaaggtggcaccagtgtacctttaaaaaaatgttcattatacttgaattcagcattactattaatagtaaatattatttagggcttagctacttttggatcatgctttatagagtcaagactaatgagaattttcttaaaatttcataaggtactgcaatatcttgacatccctctttaatcaagatgcttctgatttacatgtacatatctcagcagataactttttaaaatatcacattattgtgctacattgagcatttctgaagatttttccaagccattaactgtgaggccttggaatttgggctcttttaatcaggcatcacactcagtttttggtgttctgcctggtcaagacatagattgaaggacatttgagtaaatacgctcccttgctcctttcttgccttttgttcattttttgtacatccacaatctatgaggtatgttacctactgaaatttactttcttttccaactgtggttcaacaactgactttcttctctcatactttccaacccattccattctgaataagttaagagttttcttaccttcagctcttctcaccttccaatactaagtgaatacagcctgcctcccccttcatttctgattacaatattattctcatcatcctaggactttgtacctaatcaccagttgcttctcctaagtttattttacagctgataagccaacttggaaaatgagcccactctccctcagatacattctcttccgctgtttgaaacgtttttcattgaaacaatttggtgatattgtatcaaaataataaagtattaagctactggaa

SEQ ID NO: 201005 - DNA, 2047 bp, Homo sapiens
  Payload ID: 19674
  Gene Name: zinc finger and BTB domain containing 26
  Uniprot ID: Q9HCK0
  ENST ID: ENST00000373654
  CDS Start-End: 213-1538
ctttcccttccctgtgactggagtggggagcctgaggatgcccctgggaccgcctcataggaccccagctgagggcccagcagttggcttgggggcctgactctggcatcttataagaagtgccagaggtgaggccctaagaaaacgagcctcgggagccagcccaagaccaggcattcagtgccagtctttgagaaccactgtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacgtcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcct

SEQ ID NO: 201006 - DNA, 4443 bp, Homo sapiens
  Payload ID: 19674
  Gene Name: zinc finger and BTB domain containing 26
  Uniprot ID: Q9HCK0
  ENST ID: ENST00000373656
  CDS Start-End: 75-1400
ggagccccgaggggccggagctcctggcggtgccggatcctgacggcggccttcccccgggtctgtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacgtcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctaccatttgtacttgtcttggagctggctataaagaagtatgctggtttgttatgtactcttttcaacagtatcatagcccaacttcatctcattgaattgttcacatataccagagtactctctcttgaggaacacctgcaggcagatagttagggatgaccatgaggagcataatcaacagggatagaagtacacttatacaacagcacttacatgggcggtttctctggtagcatgtcccataagaggccatatgcttataattaatgtgtaacttgttgatgcttttgagatcaggactgctccaggcacgctaaaaatgtgctaaagtatagtgggctctctaaaaagaggctatttgggagtctctgaattttgtttcagagtttagccatcagaaaggtgagtttggccatcagagttttgtcctgtgcaccataaaagtctctgaattttcgtttcctcatgtaccttaatttctaaaacggatgataaaagttaggttggacacagaaggggcaatcaaatttctgtattcagatacctcttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagaggtggcctggccaatattgaccaaggtataactaaatatgagctagcatcttcttccttcttctcgctatcccttggctttaaaagatttagtacatgaagaataatgcattagcaaaaagctcctagtttgtgtttcccctttgtgtctccctgttggctttctgagacaacctgaattttgccaacaaaatatcgcagagggatttatattaattattttttagttagatgaatattatattcttcccatccaagtgagtgatttgctaggtttgtttagggagggaaaaagcaagaataatgtgagaagaatctaaatgcgaagttgattttgtgtggaaaactgtttattagtttccatcaggattttctgtttttatttttgagctatgagagtgcatgcagatttgaaaaattaggcttgcatagtcagaggggatcttcaattgttatatttgatacgtttacatgtatcattgttatcatatgtaaattatcatcatgtgagtcagatgtgaagtatgatttttgtcttttgttcaaatatttaaaatgataatacagttgagtggtaagactaataggtaccttatgcctaacatcactcattatatggtctaatgatgcttcctagcattgtgatttttacatgatccagccaaagagtaccaattctatgcaatagtgagactctaccctgtcaaccaaacagcattttttggtattttctgtcaacatcatttcttcacagggaaatttcaagttggagtgcttcgtttgctcacattcatgtcttgtttttgttactggtttgaagactaaaaggcacgggttcaaataagattggtctctttggttggagactatttctgggttcattcagttgttcaagaaacattagttaagcacctactgttgctagacactatgctagatactgaggataatgaaggtaagattgatatagtccctgccctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaaa

SEQ ID NO: 201007 - DNA, 2978 bp, Homo sapiens
  Payload ID: 19675
  Gene Name: zinc finger and BTB domain containing 3
  Uniprot ID: Q9H5J0
  ENST ID: ENST00000394807
  CDS Start-End: 127-1851
aattaaagctgagaaggtgggaaggggcggagctcgccctgtggctgctcggtggtgggtgaggtatcagctttctccgctagttcccaccctggtagtccttagcccctggaatgcgtgagggagatgcttagggagttctcgaagtggggcgtagaggcatcgcctggcaaggcctgggagcgaaaaagatctctacttcgtggagccgttggacgctaccggggagccactggtggggaccttttttgggccccctttccttcgtggggtactatggagttcccagaacacagtcagcagctgctgcagagcctccgggagcagcggtcccagggtttcctttgtgactgcaccgtgatggtgggtagtacccagttcttggcccatcgggctgtgctggcctcctgcagcccattcttccagcttttctacaaggagcgggaattggacaagagggatctggtgtgtattcacaatgaaattgtcacagccccagcctttgggctgcttctggactttatgtatgctggccagctgaccctgagaggggatacccctgtggaggatgtgctggcagctgccagctacttgcacatgaatgacatcgtcaaggtgtgtaagcggcggcttcaagcccgggccctggcagaggcagacagtaccaagaaggaggaggaaaccaactcacagcttcctagtttggagtttttgtctagtacttcccgtggcacccaaccttcgttggcatctgctgagacatcaggccactggggcaaaggggaatggaaaggctctgctgctccctcacctactgtccgtcctccagatgagccaccaatgtctagtggggctgacactacacagcctggcatggaggttgacgcaccacatctgcgggcacctcatccaccagtggctgatgtctctcttgccagccctagtagctccactgagaccattcctacaaactacttctcttctggcatctcagcagtttcattggagccactgccatctcttgatgtgggtcctgagagtctgagggtggtggaaccaaaggatcctggaggaccactgcaaggcttctatcccccagcctcagccccaacgtcagccccagcccctgtctcagctccagttccatcccaggctccagccccagctgaagctgagctggtccaggtgaaagttgaagctattgtgatctctgatgaagagactgatgtgtcagatgaacagcctcagggtcctgagagagctttcccatctggaggagcagtgtatggggcacagccctcccagccagaggcttttgaagacccaggggcagcaggactggaggaggtggggccaagtgaccacttcctgccaacagaccctcatctaccctaccatctgctgccaggtgcagggcagtatcatcgaggactggtgacctcacctctgcctgcacccgcatccctgcatgagccactttacctgtcttctgagtacgaagcagctccaggaagctttggggtttttactgaggatgttcccacctgcaagacatgtgggaagaccttctcatgctcttacacactacggcgacatgccacggtgcacacacgtgagcgaccctatgagtgccgctactgcctgcggagctacacgcagtcaggggacctctaccgccacatccgcaaggctcacaatgaggacctggccaaacgcagcaaaccagatccagaagtgggaccccttctaggggtgcagcctctccctggctccccaacagcagacagacagagcagcagtggtggagggccacctaaagattttgtattggccccaaaaactaacatctaagggagcatgagctgatgctaggctgctcttaccatccttagatggcagctcagaaggttggtggcaccttatcacccctgctgggtgacaagaataaaggctctgcccaggctgaaagttcctacccttttttttttttaatcttttatttttttgagacagagtctcactctgtcacccagactggagtgcagtggcgcgatctcggctcactgcaagctcagcctccccgattcacgccattctcctgcctcagcctcccgagtagctgggactacaggcgcctatcaccatgcctggctaattttttttgatttttagtagagacagggtttcaccgtgttagccaggatggtctcgatcttctgacagatctgacctcgtgatccgcccatctccacctcccgcagtgctgggattacaggcatgagccaccgcgcccagctgcctttttttttttgagtcttgctctgtcactgaggctggagtgcagtggcgcaatttcagctcactgcaacctctgcctcccaggttcaagcgattcctttttttttttttttttttgagacagagtctcactctgtcccccaggctggagtgcagtggcgcgatcttggcccaccacgcccgcctaattttttgtattttttagtagagacggggtttcaccgtgttagtcaggatggtctcgatctcctgacctcgtgatccacccgcctcagcctcccaaagtgctgggattacaggcttgagccaccgtgcctggcctcaagcgattctcttaactcagcctcttgagtagctgggattacaggaacgcgccaccacgcccagctaattcctgtatttttagtagagacagggtttcaccatgttggccaggctggtctcaaattcctgaccccaggtgatctgcccaccttggccttaaaaagtgctgggattaaaggcgtgagccaccatgcccagcctcctacccttttctttgcccagccagataagcaggactttatggggcaaagcctatgtcagctctctccaagggcactgggaattttcctgaggtgtaatcgcttctcactgtatgttctggaacataaagctagcaatgaaggtatttctttgaa

SEQ ID NO: 201008 - DNA, 432 bp, Homo sapiens
  Payload ID: 19675
  Gene Name: zinc finger and BTB domain containing 3
  ENST ID: ENST00000527994
  CDS Start-End: 86-432
gagctcgccctgtggctgctcggtggtgggtgagggagccactggtggggaccttttttgggccccctttccttcgtggggtactatggagttcccagaacacagtcagcagctgctgcagagcctccgggagcagcggtcccagggtttcctttgtgactgcaccgtgatggtgggtagtacccagttcttggcccatcgggctgtgctggcctcctgcagcccattcttccagcttttctacaaggagcgggaattggacaagagggatctggtgtgtattcacaatgaaattgtcacagccccagcctttgggctgcttctggactttatgtatgctggccagctgaccctgagaggggatacccctgtggaggatgtgctggcagctgccagctacttgcacatgaatgacatcgtcaaggtgtgtaa

SEQ ID NO: 201009 - DNA, 490 bp, Homo sapiens
  Payload ID: 19675
  Gene Name: zinc finger and BTB domain containing 3
  ENST ID: ENST00000530112
  CDS Start-End: 1-10
taacatctaagggagcatgagctgatgctaggctgctcttaccatccttagatggcagctcagaaggttggtggcaccttatcacccctgctgggtgacaagaataaaggctctgcccaggctgaggcaggagaattgcttgaacccgggaggcggaggttgcagtgagccgagatcacgccattgcactccaaccctgggtgacagtgcgagactccatctcaaaaaagaaaaaaagaaaagggggaaaatgacaagtaaatattcttctctctttttgagtctgtgtcatattcagcactgtgaacccttaccagcaagtgactatttttgagttacaggaaggaaaggtgagcagccatgtggctaaagaaagctccttaactaggacatatgggaagcaaaagatggttaacatttttctgctgaatgaattctacattctttcacattctttgtgttgaaataaacttctagcttatctttcaaa

SEQ ID NO: 201010 - DNA, 1960 bp, Homo sapiens
  Payload ID: 19676
  Gene Name: zinc finger and BTB domain containing 32
  Uniprot ID: Q9Y2Y4
  ENST ID: ENST00000262630
  CDS Start-End: 211-1674
gccgtcatctctaagaaacaaccataccactgaatgctactgtgtacttacaaaccacactcatattcgtcacgtcatttcatcttcacccccacctccaaatgaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttca

SEQ ID NO: 201011 - DNA, 2068 bp, Homo sapiens
  Payload ID: 19676
  Gene Name: zinc finger and BTB domain containing 32
  Uniprot ID: Q9Y2Y4
  ENST ID: ENST00000392197
  CDS Start-End: 319-1782
ggcctcgctccattccccacttttaacggtcactcggccttaagccgtcctgggtgtatgtgaggctgaaagggaaggaggaacagggtctgggccgctgtgtgctctgccgtcatctctaagaaacaaccataccactgaatgctactgtgtacttacaaaccacactcatattcgtcacgtcatttcatcttcacccccacctccaaatgaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttca

SEQ ID NO: 201012 - DNA, 1733 bp, Homo sapiens
  Payload ID: 19676
  Gene Name: zinc finger and BTB domain containing 32
  ENST ID: ENST00000481182
  CDS Start-End: 127-1035
gtcctggaagaagctacaagcggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttca

SEQ ID NO: 201013 - DNA, 469 bp, Homo sapiens
  Payload ID: 19676
  Gene Name: zinc finger and BTB domain containing 32
  ENST ID: ENST00000426659
  CDS Start-End: 257-469
ccgtcctgggtgtatgtgaggctgaaagggaaggaggaacagggtctgggccgctgtgtgctctgccgtcatctctaagaaacaaccataccactgaatgctactgtgtacttacaaaccacactcatattcgtcacgtcatttcatcttcacccccacctccaaatgagcacccccaccactggagcctggcaggaggtctggcgggaacagaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgt

SEQ ID NO: 201014 - DNA, 5211 bp, Homo sapiens
  Payload ID: 19677
  Gene Name: zinc finger and BTB domain containing 33
  Uniprot ID: Q86T24
  ENST ID: ENST00000326624
  CDS Start-End: 229-2247
gcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctga

SEQ ID NO: 201015 - DNA, 2346 bp, Homo sapiens
  Payload ID: 19677
  Gene Name: zinc finger and BTB domain containing 33
  Uniprot ID: Q86T24
  ENST ID: ENST00000557385
  CDS Start-End: 328-2346
tttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcagtgtctgttgacttcacttggcactgtttaacattccacctctggaaattgtaaagatggagagatgaggggaagggacaaggggatgaagaaagaggaaagggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaa

SEQ ID NO: 201016 - DNA, 6564 bp, Homo sapiens
  Payload ID: 19678
  Gene Name: zinc finger and BTB domain containing 34
  ENST ID: ENST00000319119
  CDS Start-End: 86-1600
cggggactggcctggcgccggcggcggcggagggggcgccgcgggcgggcgatgtgagcgcggcgctctggacagagtacgcttcatgtcagtagaaatggacagcagcagttttattcagtttgatgtgcccgagtacagcagcaccgttctgagccagctaaacgaactccgcctgcaggggaaactatgtgacatcattgtacacattcagggtcagccattccgagcccacaaagcagtccttgctgccagctccccatatttccgggaccattcagcgttaagtaccatgagtggcttgtcaatatcagtgattaaaaatcccaatgtgtttgagcagttgctttctttttgttacactggaagaatgtccttgcagctgaaggatgttgtcagttttctgactgcagccagctttcttcagatgcagtgtgtcattgacaagtgcacgcagatcctagagagcatccattccaaaatcagcgttggagatgttgactctgttaccgtcggtgctgaagagaatcccgagagtcgaaacggagtgaaagacagcagcttctttgccaacccagtggagatctctcctccatattgctctcagggacggcagcccaccgcaagcagtgacctccggatggagacgacccccagcaaagctttgcgcagccgcttacaggaggaggggcactcagaccgcgggagcagtgggagcgtttctgaatatgagattcagatagagggagaccatgagcaaggagacctattggtgagggagagccagatcaccgaggtgaaagtgaagatggagaagtccgaccggcccagctgttccgacagctcctccctgggtgacgatgggtaccacaccgagatggttgatggggaacaagttgtggcagtgaatgtgggctcctatggttctgtgctccagcacgcatactcctattcccaagcagcctcacagccaaccaatgtatcagaagcttttggaagtttgagtaattccagcccatccaggtccatgctgagctgtttccgaggagggcgtgcccgccagaagcgggctttgtctgtccacctgcacagtgacctgcagggcctggtgcagggctctgacagtgaagccatgatgaacaaccccgggtatgagagcagtccccgggagaggagtgcgagagggcattggtacccgtacaatgagaggttgatctgtatttactgtggaaagtccttcaaccagaaaggaagccttgataggcacatgcgactccatatgggaatcaccccctttgtgtgcaagttctgtgggaagaagtacacacggaaggaccaactggagtaccacatccggggccatacagatgataaaccattccgctgtgagatctgcgggaagtgctttccattccaaggtaccctcaaccagcacttgcggaaaaaccacccaggcgttgctgaagtcaggagtcgcattgagtcccccgagagaacagatgtgtacgtggaacagaaactagaaaatgacgcatcggcctcagagatgggcctagattcccggatggaaattcacacagtgtctgatgctcccgattaagatggtaaagaagtgcacccaaacaaagcacattaatcaatgcatatttgtgatttgctttgttgtaatctttggttttcccaaccatctggaaatctcttggtctcttggcagtttttctaaagtttctggatggaacacttcgttgtgtttatcctttcccctgccctccctccccgaaggagctcaaagcatgaagggcaacgcatccagggaaaacacaggctgacagtattcctctttggctgaactcttaatccaaaatctgccagtgatttagctatgccaactggttgaccctccattctctgccaagaggcatactctttctcattgtgtgcgctggcagcagtgcacttccacggagggagattaggatgccgtcagctgatacaaatgggtaaccttttctaatttaaaattccttttagggggtagttagacaatttatatatatatataataaaactattattatatatatagtatatatacattttcaaatttgattttattctggttgaggtgaatgtaagaggaatatataatttaatacaatgtgaacagggcttctgagtctatctcatccctacctaatatgttagggttttgccccttcatttcccttacaaaagaatgttagtaggtttatattaatcattgtgtccaaaagcaagcaaagcaaatcacagtgttcacagctctgcttcataacaaatacataaaccaaatgccataaaatttcttcaactctagttggaaaccgtttggaatttttgttagttgtccagcaggtaagctggatgacctgtggtgctgacctttttacatagtgtagtgttatattagccaaccccaaaggagcagtggttttcaaggtttttactggcctacaaatctaccttcattccgtactgtagaaacatacataccaggtaactaaatcgaatcactctctatcatgagttagtactcactcgcacttaaggaaagggatttgtagttctgtctacaaaattctccaagcagtgttgtggttttttttgtttttgttttttttctttctcttttcaaacagccagttcaggtgcacagcaactttttctacatgcagttcccagggaaactgcagaacttagaatttgtactttttgtaaagctatactctatgggaattgcaagcaatatatctatcttagtattgtgtgtgctaatgagagcctcagtggctcccccactctctcagtgtttcctgcttaaagaaccaacagtttaaaagccctctaagatactctgtgtgtcaccaaatctgtgtgtcaccattttttggtcatgtggtgctatttttgttaagtgtctttttaggtcagtatagttgtagaaaatgtgaaatctgatggtaataatgaattataattgttttcctctcttgagttcatagcttgaaaagagacctcaaaagcatgtgctggcaaacacgttactgtatgaaaacatacctgagtccatttgaataatgttttattagtactttcggaaatgtcttcagttctgtattgtgttcacatacacaaacaggctttacaagattgcttcggtactgtaaactctggcagagagtaattttgtaggcagtttggtggtgagtttgtgctgcaggctgcctgtgggatgtcagcgttctggtatctgcctgagaacctgggctctgagacgcacaaccagtgcacctccataggagaacagtgcagccacctaaaagaaaaacgaacgaaggaccagcctcagaggctagaagttaaaggaatacagaattagatgtttgctggttttctgtgcttttttggctcctaaaataccaatggtggatttgtttttgtttttgttttttgttttgagaaataaaaagtcattcaagccctttgtgtgtaatagcccccaggggtggcagctgtgcagtcgcatctctttggcacacaggatctgttcacgtgtgaactgctgcgctacacatcagtgttaactccctacagattacactctaatcccgctgctcccgaggagcggctttgctaaatcgggtatatagtatatgcctttttcctcgtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaagaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcagttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagcaaa

SEQ ID NO: 201017 - DNA, 6528 bp, Homo sapiens
  Payload ID: 19678
  Gene Name: zinc finger and BTB domain containing 34
  Uniprot ID: Q8NCN2
  ENST ID: ENST00000373452
  CDS Start-End: 65-1567
gaggagtcattggtgaatgatgcaaactctctctctccgcagagtacgcttcatgtcagtagaaatggacagcagcagttttattcagtttgatgtgcccgagtacagcagcaccgttctgagccagctaaacgaactccgcctgcaggggaaactatgtgacatcattgtacacattcagggtcagccattccgagcccacaaagcagtccttgctgccagctccccatatttccgggaccattcagcgttaagtaccatgagtggcttgtcaatatcagtgattaaaaatcccaatgtgtttgagcagttgctttctttttgttacactggaagaatgtccttgcagctgaaggatgttgtcagttttctgactgcagccagctttcttcagatgcagtgtgtcattgacaagtgcacgcagatcctagagagcatccattccaaaatcagcgttggagatgttgactctgttaccgtcggtgctgaagagaatcccgagagtcgaaacggagtgaaagacagcagcttctttgccaacccagtggagatctctcctccatattgctctcagggacggcagcccaccgcaagcagtgacctccggatggagacgacccccagcaaagctttgcgcagccgcttacaggaggaggggcactcagaccgcgggagcagtgggagcgtttctgaatatgagattcagatagagggagaccatgagcaaggagacctattggtgagggagagccagatcaccgaggtgaaagtgaagatggagaagtccgaccggcccagctgttccgacagctcctccctgggtgacgatgggtaccacaccgagatggttgatggggaacaagttgtggcagtgaatgtgggctcctatggttctgtgctccagcacgcatactcctattcccaagcagcctcacagccaaccaatgtatcagaagcttttggaagtttgagtaattccagcccatccaggtccatgctgagctgtttccgaggagggcgtgcccgccagaagcgggctttgtctgtccacctgcacagtgacctgcagggcctggtgcagggctctgacagtgaagccatgatgaacaaccccgggtatgagagcagtccccgggagaggagtgcgagagggcattggtacccgtacaatgagaggttgatctgtatttactgtggaaagtccttcaaccagaaaggaagccttgataggcacatgcgactccatatgggaatcaccccctttgtgtgcaagttctgtgggaagaagtacacacggaaggaccaactggagtaccacatccggggccatacagatgataaaccattccgctgtgagatctgcgggaagtgctttccattccaaggtaccctcaaccagcacttgcggaaaaaccacccaggcgttgctgaagtcaggagtcgcattgagtcccccgagagaacagatgtgtacgtggaacagaaactagaaaatgacgcatcggcctcagagatgggcctagattcccggatggaaattcacacagtgtctgatgctcccgattaagatggtaaagaagtgcacccaaacaaagcacattaatcaatgcatatttgtgatttgctttgttgtaatctttggttttcccaaccatctggaaatctcttggtctcttggcagtttttctaaagtttctggatggaacacttcgttgtgtttatcctttcccctgccctccctccccgaaggagctcaaagcatgaagggcaacgcatccagggaaaacacaggctgacagtattcctctttggctgaactcttaatccaaaatctgccagtgatttagctatgccaactggttgaccctccattctctgccaagaggcatactctttctcattgtgtgcgctggcagcagtgcacttccacggagggagattaggatgccgtcagctgatacaaatgggtaaccttttctaatttaaaattccttttagggggtagttagacaatttatatatatatataataaaactattattatatatatagtatatatacattttcaaatttgattttattctggttgaggtgaatgtaagaggaatatataatttaatacaatgtgaacagggcttctgagtctatctcatccctacctaatatgttagggttttgccccttcatttcccttacaaaagaatgttagtaggtttatattaatcattgtgtccaaaagcaagcaaagcaaatcacagtgttcacagctctgcttcataacaaatacataaaccaaatgccataaaatttcttcaactctagttggaaaccgtttggaatttttgttagttgtccagcaggtaagctggatgacctgtggtgctgacctttttacatagtgtagtgttatattagccaaccccaaaggagcagtggttttcaaggtttttactggcctacaaatctaccttcattccgtactgtagaaacatacataccaggtaactaaatcgaatcactctctatcatgagttagtactcactcgcacttaaggaaagggatttgtagttctgtctacaaaattctccaagcagtgttgtggttttttttgtttttgttttttttctttctcttttcaaacagccagttcaggtgcacagcaactttttctacatgcagttcccagggaaactgcagaacttagaatttgtactttttgtaaagctatactctatgggaattgcaagcaatatatctatcttagtattgtgtgtgctaatgagagcctcagtggctcccccactctctcagtgtttcctgcttaaagaaccaacagtttaaaagccctctaagatactctgtgtgtcaccaaatctgtgtgtcaccattttttggtcatgtggtgctatttttgttaagtgtctttttaggtcagtatagttgtagaaaatgtgaaatctgatggtaataatgaattataattgttttcctctcttgagttcatagcttgaaaagagacctcaaaagcatgtgctggcaaacacgttactgtatgaaaacatacctgagtccatttgaataatgttttattagtactttcggaaatgtcttcagttctgtattgtgttcacatacacaaacaggctttacaagattgcttcggtactgtaaactctggcagagagtaattttgtaggcagtttggtggtgagtttgtgctgcaggctgcctgtgggatgtcagcgttctggtatctgcctgagaacctgggctctgagacgcacaaccagtgcacctccataggagaacagtgcagccacctaaaagaaaaacgaacgaaggaccagcctcagaggctagaagttaaaggaatacagaattagatgtttgctggttttctgtgcttttttggctcctaaaataccaatggtggatttgtttttgtttttgttttttgttttgagaaataaaaagtcattcaagccctttgtgtgtaatagcccccaggggtggcagctgtgcagtcgcatctctttggcacacaggatctgttcacgtgtgaactgctgcgctacacatcagtgttaactccctacagattacactctaatcccgctgctcccgaggagcggctttgctaaatcgggtatatagtatatgcctttttcctcgtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaagaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcagttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagc

SEQ ID NO: 201018 - DNA, 19128 bp, Homo sapiens
  Payload ID: 19679
  Gene Name: zinc finger and BTB domain containing 37
  Uniprot ID: Q5TC79
  ENST ID: ENST00000367701
  CDS Start-End: 192-1703
agactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaagaaaaaaatgaatactggtggttcttattttgaaaggttaggctttatctttcccctgactaggcatctaatactttgcctggttatttcatataatcagccatcttgaagcagtattctagtggacaacatcacctgaagcacttggcaactgggagtgaaatgagcagcaaagtgtatgcaataggtactgctacatttggggggcttgagtgttgtgttgaggaagaggagagcagggagggaagtgtttttatgttttgcaaatatcaaacagcacagagccgttctgcaacttcctgactggtatttgtaaaccatagtgctacacatccttgggtaatggctctagttcaggtgaattaatgtgttaggctgactaccaaagtttcatctagtctctttggctcctattttcacgttcagcaatattgtaatcaaaaatgtcactttccagtgaaatgagcctggattgtatttttaaatccacaggtctccatatttgataacttttatatgaagttttaaacatgttttttctgcagtattgtggttgaagaaattcaacactatggttcttactgcaaccacaatttcatttccttatacatatgtaatagtttatattttcaggcatatagaaggacctcacttaaaactatgtctcgggtctgcaaacctagtaattcataaaccaaccatcagcaaaccatagctggtgactccaagagctttgctttttaataatatactacagggcacttatcagaaaacatcatgcagaatcatgttgcaataaatgatcaaaggatcaattttggtcaggtttggttacttagtcattcctaagatttttaaaacttcaagggacccttttagtaattctgggtatttctaagattcttaatccagcactgagagaaagaacttagcaaacatgtagagctttggataccccgtctttcatgaagtgagagaaggaggaatattaagggatgccggcaaatagatgcttataacttacagtgcaagttgaaaaatctctagcttctgttgacggagcactagttgttggggttcttttaagtatgtaatggtttaagaaattgtttcagtgcagaggcatagatgactgtaaaagagatttggcagagggacaggttgtacctgcactggtgaaccatctgtgagaatgttagtcatgtgctcctttcctgagattgctttgtggtatgtgaaaaggtgggtagaaaagaaagaaatctctttgagataagaaattagaatgcaaagggtagatcttaagcaatctgagaattgtacatgtacataaagctgcaccctctcacaagagaaaggttattttatcttctgaaaaagcatagaaatgcatcttttatgggaagataatgatgctaccatttaataagagcctacccttaaaggcagcattgaaactgtattttgtctttagaagacatagactggtgcatcctccgctttagttagacaacagcatgataaggaaaaaactgtcttctaaagccatctttagggactggctgtgctctgtggcatagaaaaggtaaagttgaattagccaaaaatccttagggaaacaactggtaataaggttttcagtggacagattttgtcattactaaataggcagtgaggtgagaagtacagattatgctgctttggatggagcctttaagcctaccaaaaaacttttaagtccatcctacttttgagaaatagtatgctagaaagttctgtttttctttttcttcttttttatattttttagagactgtgtcttcctcttgtcacccaaaccagagtgcagtggtgcaatcatagctcactgtaatcttgaactcctaggctcaagtgattgacctgcctcagcctccaggtagctaggactataggcatgcaccaccatgtctagctaatttttaaatttttttgtagagacggtgtctctacaaaatttgcctaggttggtcttgaactcctggcctcaagtaatcctaccaccttgacctcccgaagtgctaggattacaggcatgagccagtgaacttggcctggagaaagaattctttgttgctttgttagtttcttagattatatgtgagaaaatggagctttttaaactattaccaaattttaaaggtgaagtgcagtaatttctgtaaagagaaactttgcagcatttgtcaattctccttccagggttagcaacaaacaaatgaggtagggactatctcattcatgtggaaatgctatgaatgtttggtgggtttcccctcccttttcttttcattcactttaaatagccttttcctatattgatactgtgaatagggtgcttcctggtcatctaggaccactttagcacaatcatgtttgctggttctctcaattggcctagccagagccacaaaattcatgaaaatttaaggcaggctagcttttaaacaaattaaaacttctgaaaacaatttcagctttttcgttaaaagagatgttgttattctaaataactgtccaagactcttacccacatacactgtgacattgtcctagttcttagctaacaacacattggtcataggagttactgatgttctatctacattaatgaacagctattggtgtatgcacagaggatacctcttaaggatgtactaaatggactttgtttggttgatgctgaaaattaattaccaaatcttaacttgcacgtgttaccttgtgaagggaactgcattagcaatgagagctacatcatcatgaagtactttaatgccatgaaattgcaaacactgggactgttttcatttattgagtggcacttagtagcaaaggagctatccagtattctcagcaaagaagagagacggaagtatattaatctattttcatactaagatgttcctttattctgtctgaactctaataccagtataaaatatagcattggcatgaacagttaatgctgtacttaggcagaaaggctccttctaatgacttgttctctctttactcagaaccgtatttacctctgaaccaagttgaattttattttatccaagttgcaaactaccccatgccatttttattataatagagggttaaatctaatctcaaatacataaaggtaaattagttcatagaggataaagtttgggaatgaagagagcagttaaggaaaattttattttttgtcattttttaaatgtttccagttccctctacatcagtgaaacagggttttccaaagatggtttgaagatagaaaaaactttttccccccgacttcatagttgacatctggtattggttggaattggtctggtggcagagtgaagtagggaacttcatttttttcttttttttcttaaaggcagggtctcactatgttgcccaggctggtctcaaactcctgggctcaagtggtcctccttcctcagcctcctgaggagctgggactacaggcgtgtgaccacacctggctgtaaatgtcattcttaatagctgaataatctttggtcaagaagtaacttttccagagttttagctgttacttgacattaattgggtttcttttaactggtgaaaactgtatttattttgtttgaccagactgtctaacttaaatgaaagcaatggataatggaaaggaaactgaacaaagacaaaagtcttcttcatcatagtgaaaggcatttaatcaggaagagttggaatcctggaagtttttctttttttcaggtacaagaggcatgatttttttctcttcctaaaatgtccttccccttatctgtgtacttattagttcaaggaataacaaatgagtcttaattgaacttagtctttggaaattgagctctttatttaggttatatgtgaaagagtttaaaatattgaaatactttggttgctaagcagatttagaaaagcaacaagcaattgtcgggcaaatccctaggtttgagaagatgtcctcagcaaaatatacccttaggacttacggaattagatcagggttcagcaaacagtagtttccaggccaaatgctgaggctacttgcttgtgtaaagaaaattataatggaatagggccacacttacttgtttaggtattgtttatgccttctttctactacaatggcaaagttgagtacttgtgacaaagatcacgtggctacaaagcttgaaaatatttactgtctggtacttgttagaaaaaatttgccaactccaagaaagaattacctcctaaagttgttactcatgacattttgcctttataatagtttggttgaagttttaaattcatgttgtcacatatacatgttttcttgaaagagtttgccaactttttctagatcctcttatcataactctttttgtgctccttcatgatttttttgtgctccttcatgattcccattactttaaaagcatttagaattggcctgttgtttgtccttgtcttaatggtgccggtattttaaagtttagttgtaagtaagttttgccattcctctgagttaacttgaactggtttgcataatggtgacaagaatgaattttttcccaagtggattaaaaactaatttcattatgaagaagtattttgattcatatccaaagtactgtttttctggattagaacccctaccttttccctttgcaatgtatcttaattttaacttctttaaacttactctgttccatgtagagcagtaaaaagccaagtttttcttccttttttcctggatgttttgaaacataatgaaacatctgaggatttcaaattctttttagacctatcttcccatttctgttattgtctataattcttctaaatacatattggaccattaacatgtttgctttgtgaatgttcattcttagtgttcagatagcctacttatactcgatgtgggaaaaatgggaaatgttagggggttcataaacagaaatccttgcaggaagccgggtgtgacagcagacacctataatcccagctacttgggagactgagctgagaggcccacttgaggccaggaatttaaggaccagcctgggcaacatagaccttatctctaaaacaaaaaaaaatccttgcaagaagagagaataattgcttcccatttggaaatgatatagggacttttgaattagatctatcttgacaaagttttctaggccatgctgatacagtatagggagtttgaatctgttgtgagcgctgtcaacatagacaaagttcaagtgagtaactagctttctataatagggactctcttcactaggtattttaaagttgctgctttctaattggatattaggaagttttatatgatataccctctgagtaatagataatcctcatctataaagttccagaatatttgcctaggttagatctcccctggcttagagcagttatacctatagtaacagtaggtttttgagattttggagtattacttttctgattaacctaggattctgattaacctggaaggtgggacttgtgaaagaaattggattttgttagcccagtgaatcatctgcatcccactctatttgaggtcttggtaatagatgtcaatttaaatatgcatctattgaaagcaatggagttttccaagcattatgacttccttgataattttcagtcttatcttttttcgtattttctagtctctttccctgtctttagtcttcttcctcttaaatggtgcttttcccagggccagtctttctactttctaagcaagcaggcttttttgttcaggataagccagagttagatattatgaatactttgaaacatctgaatatgttacattccaaagtatgtaattattgatagtagtatcaaaacctggaagatattggtgcagattattcagttttgctgtgtaggcaggctgtctttctcctcaactgtgacacagcagtgacttgagaaggcaaatattacttgaaacccccattatctttatagagggtacgtatataaattttcttacctgacatttttaccattatcaatatatcagtagctcacatcttaacatagaagaagcccattagctcaaatactggaaacttcaaacaaggaaataaattacaaaagcaaagcagttaatgaaaaaaacttgtctattgcctgcgtctttcatgtctactcaataggtcctgttgaggaggctagaatacaccatccggttaagaaaggggttgttttgttttgtttaagacagagtcttggtctgtcttccaggctggagtgcagtggctcaatcttggctcactgcaatctccacctccttggttcaagcaattcttgtgcctcagcctcccaaatagctgagattacaggcgtgtgccaccatgcccagctaatttttgtatttttagtagagatggggtttcaccatgttggccaggctggtcgtgaactcctggcctcaattgatcctcctgcttcggcctcccaaagtgctggacttagaggcatgaaccactgcacccagccccatttaagagagttttatattcagcatctcatatggcctacaccatgattttaatatactgtgaatcttaggatttcagttaatccataatgccaggagttaaggtatttcatgggaacatgtttcctcttctatgaaatcacctgtctgcagtgataggtaatgtataagagaatgtttcattaagtaaatattaagtactttttgataccagacaacatgcttgggatttgtataataaaactggttttagacatagtttagacatgatgtgtcttcctatacttgagagtcctaagcccacttggttggcgtctgggatgtattgcttttgaaaagcctgcactttttactgtagagataaaagatcaaaaaggggacagaattagctttattaagtgctttatcgtcataactgtggttaagacaataatactatgaggtaataacagtaatgttaaaaataactaactttttttgaatgcttactatgtgccaggcacagttctatgtgcttcacattgattaactcatctaatccttatgacaatcccatgagggtagataacatcctcattttagatgggaagaaacagacacaactgactcaggctaacactagagttgcctctagtaggtgtaattatatcatattttatagatgaggaaactgatgaacccaaggttacataactggtaaattacagagccaatatttaccaatcttgattccaaagcccagactatctgcatgatgtcatattgactccatttacttatcaagagttgaagttgactggaatatacagtagccaggaacagtactgctttttgtgaatgtgtaattcaagagtaagtgattagaaggttcttcaaaagctgatgcagttgatctctgagcagagttgaatagtgaatattttcagtggatattgcccactgattcaagggagtcacccgtgtggttaggtctaatagtgagtgaggtactatcaaggcaaaaattgaaagagttccagttacctattgctgtgtaacaaacttaattaaaattaagtaattttaattacttaaaatcaaccatttcctatatcatggttttgtgaatcagaaaatccaggaagggcttgtctgggcaattctcctccctgtgacaacgactcaggtcacctggtggtattcagcaggtggttagacaagtctggaaggagtgtccaagatgatcgatcttacatacctgacactttggtggggagactagaaggatggactcagcaggtctcctctttctctccatgaagtctaaggactctccatgtgttctcttcatcaaggtagtcagatttactacgaggacagctaaggcctctgaaaggctgggcagaagaatctagtcaacttaaaggccaggcctagaattatcatacagccaccactgtactcttggtcgaagaacttaatggtaagatgacagcaagaatgaagggggaaaaaagaactcaatggtcagcccaaatttaaggagagaagaaataccctaccactttatggaaggcatgtccaggacttggggctatttttaatgtgttaatgttttttttgttttgttttgttttttgtcttgactctttggtgtttattcatcagttgtttgtgctgtagaaaccatttattatgtctaccatgggtcactaaaggagctagaaggagaatgagacaaatatctggagcatacttcatttgctgccctctccctccaagtttcatttatcttatagcaaaattttcattttgtactgtgttccaagttgtgaacatttgcctggttttgctctgaagccacggtaactgcatgcggagctagaaatactctagagggagtaaaaagcttacattttttttgtttgttttttgttttaggacagagtttcactctgtcacccaggctggagtgcagtggtgcaatcacagctcactgcagcctcaacctcctggactcaagcaatcctcctacctcatcctcccaagtagctgggactccagacgtgtgccactacacctggctaatttttgtgtatttttagagacgggatctcaccatgttgcctgggctggtcttgaactcctggactcaagagatccaccttcctcggcctcctgaagtgctgggattacaggcatgagccaacgtgcctggcccggaaagcttactattaaataatttgatttcttggagatatcagttgtattttaagtttacaaataggtgaatactcttgtggtatggaaacattgcatggctgctgaatctctttcaacaggagtttctattgggtggctacatggatcatattcttgagatagtgaaaagttttacctacttatcttaatcccattctacctctacacctccagcatgattttgtgctcgaagatgaatcaattcctttcattcttgttacctttcatacaggaaaattcatcgcccaattttatatgttgttaatcttttaaaattggcagttgttaccagcctctctcatttaaaataacagatcattgaagttttttgatttttggttagatgtgtcagatttaggatgccttatttaaactcgtgctgtcttactagactgttcctgctctgagaagaaatatggacagagaatgaatttcattgtccatattgatgaaccccaaatcaatacacttcttaagaaaggtttgagattatccagtccatgtgcaatgaatccttggagcattagctgtgtggccttcctactgataatctgcagttatcacagtaaagagatctctgttcctaggtcaggccttagcaattacaaatacaggaaataaaggggtactcaatgctgaagacttaattttgggtacctacaaagtcctgggaagggaaaaagaagaccttggcatttgtatttgcataaccagagatggaatgtttgaggcttttaggcataaagattaattagattttatcatataaagattagggcaaattatttttttttccagttcattcttaacatgttaagggacaaattttaatgaataaaaatttaaaggccttaaaactttcttttggattcacatttccactctggtataatccactctggtgtagtctgccctttatgacagagaaagcctttgaaaatattgtcccagggaatgaaaaatcttaatgatgatctatggaaatgtctctcattctctattacagccctttgggccctcctatagattctctgtgaatttaagtttgaaatcatttggtgtttgcatgaaaaataattcttactattcatttaaataattcttaaatgtggtcttaaattgcaagagagaacaaagccagaaaaaggggaaccttgtagattgaccaaatatttattctttattttcagcatcacaaatctaaaccatttcaagctaatacaacaacctgagtgagtagaaattccttaaggtttagatttctgcttttagtcacatcttgaagcagatgtttatgacatatttgaagatgatccactgagtttcctataaagtaatagaatcctaactatagtggttctttaagaaccactgaaaaaacagaattgcagtgcagggaacaaagcttaaaatgtgtttcctctggaagccaagatgctaaaaaaggggtcactaatagtgtgactgaagtccgtctctagaatggctatctgttagatagcagaaatatttagaatgtatatggcatttctaatatttttacaaaaataattttaaatcatgtaactcgaattttttttaaaaagtctgttttctttttggaaaactggcacaataaaaataacactaatataattccattgtatatgcatgtgcattgaacccagagtgggtatactaaagatagttcatgcaaataacttatgggaagtttggctattttttcatgtatgtttataaatatatttagtcatctactgtgaccttggtagcacagaagcattttgttagctgtatcattaattctaaaaatcaaattcttggcatagtaggctatgagagctttttgttacttggtattttggctaagaaaattatttcttgcactttctatttgtaaagatgttataacacaatgcacccacttaatgcagcttttctttagagaaaaaagatgtaggtgtaaaagtgaaatgtatgttttcaaacctggcaaaaggagggacctcaaaaaaataaatttggcttgccatctacctgagtagggttggggattaatataaaacttaggttgaaagtggctgttgggataggtatactgttgctgtgaattgcaatattgctgtgagttgccagctatgtatgtgtaagtttatgtgtgtatgtgagaaaaaggtatttcgtgaaggcataaaagtcagtgtagaatatcctacctcccactagagactgagcatattcaagattgctctgtagtcccttgggcaggaagctggattcctcagccactgtctaccccattcttctctatactcacttcagctcctctacctctgagcacttggctgaagaaagagtatagctttctgtagcaagcaaaggaaagccagacccaaaatagagaggctgcagtatctgaaattcttatcatgttcagatatcaatatttaattttgttgcccaaatcaaacaatgtcagaacacttgagtttagtgcttttttttctctctctgtctcctacagacttctcccggtttactgcttttatccactggcttctgtttggcaggagtagccagtggaggtcaagtctgtttttaaagactaaaacacctaattccttttaatgatgtgtaacatttgtttgaatccccaacttctttttttttggggggcaggggtagagatggagtctccctatgttgcccagtctcgtcttaaacatctaggtttggttggatgcagtggctcacacctgtaatcccagcactttgggaagctgaggtaggcggatcacctgatgtcaggagttcgagaccagcctggccaacattgtgaaaccccgtctctactaaaaatacaaaaaattagctgggtgtggtggcggcatctgtaatcccagctactcgggaggctgaggcaggagaatcgcttgaactcgggaggtggaaattgcagtgagccgagatcacacggttgcactccagcctgagcaacaagagcgagactccatctcaaaaaaaaaaaaaaaaagtctgggctcaagcgatcctaccacctcagcctccccaaagtgataggattacaggtgccagtcaccacacctggcccatgatggattttcagatgacctcttttacttctaatctctccaaagagagatattcttgtttttaaggtcaatattgtcataatagtcatgatgtcctcacctgaatgttgtaggtgtcagaaagttgtttcaatagtaatatgccaccaggcagaccacctaatctttaaatccagttgtagcactcaatttattttctgtttggggcactagtgcactgagccaagtcaacttgtccacttttctaatatttcttacagctaaggaggaactgttggtcctttgatatcctagaatgctttctacttgtggaaatgctttttaccctaatacactgattatattgtctaaatgtctaaacagggattctctggttagaagtgaaatgagagagtgacccattttcagatttttagagattggctcccgtattttaggaactagctgataagtatttagtttcctggtgactttggatacggcaagtggagatgcagagaatgtgaaattccaaataataagacaagcattactcacaaataacaactgatacagtaatttctgcccaaatgcagtaagaatcttgtagggagatgaagtggtaaaattaaattatatgaatctttttaccacgactatttttttttttctacctgtagcatagttctctgcctataagccatgctaatatcctagacccaggaattaattcctgcttaggaaaatttttccttctggcttatcttttgtttgtgcccagagttttgtcctaggcctgtcccctgatcttttgctataacacatacttaaggtgcagccttcttacctaaatcagtactttactgttgctgttgctgcctattacagccagttatttatttaaaaagtagtgaaaaaatgcctaggtagtttgattgcagcatgttaaatccataaatctggacagaagccatggagtcttaccttttctctctctagcttggatgaacaccggccttatgctttctattacaggactagttgacccagttcttcatattggttgcacattagaattgcataggaccccctctagacatttacattttattggtctgttgtgcaacctgggctttaggtgattctaatgtgcagccaaggttgagaatcactccctatgtaatccctagtggtcatggcaggataacctcaatccagtcctctttgacctgaaaatatctttattgatattccatgcatggctctcaattcaaagtgtacagtgggtcaaggcttaggtagtaaaatggatcatccatttgtcctcagaataattctggagggagatattgtcatccatccagtttcctctctataccaaatacaaagtacacataaataagcaaaacaaattttcaaagttccttctctagaatcctctttcttttgcatatgtagtttcagtggagatttctcaactagctgaaatggagcacttgaatatattaaaagagcccaaactgcttacagcaatttctatttgtaaaataaacaggtggcattgttaatggagaaaaggaaggatcctgcctgtggtgatggtaatatgtttgattatttatctcttagcctgtcttctaagtgggatttcagtgtcagttaactttcacttttcttggattgtttttttgtgaatgaaatgaactagttaaggcttaagtatttctgaataatatatgaaatgtgaaatgagtcattttaggatctttcttctgggatgtcaaagacctaaccaagtaactcccaaatgaggttccagattcatttttctcatcccaggtagtaaacgtgttttaatgggtttgtttcttgcccatggcaacctcaacacagaggggagaactgttttattaccctaaaatagtgagaaccactgttcaaactaactagctaccaagtgacttctaactcatgaagaaaatttgtatttaagagcaagttcaaatgtagcaggctctcttctgagagtattctggataccacggaaagtttcatttatatattgcttacaagtacgtggtaatttgaacttcagtaggtgatatgtgcaaggagaaaaagtaggtcaaggagaaagttggttagtgcagaggactgacttagcatcagtctgtgaaatttcattaaagtagcactaaggcctggctgtttgcttagcatgtaaatgctgcagtgtccaagaaaatgcctcctatgccttagaaaatttgctgaaggcttcctgttactggtggagtagaaaagcaatagcctttgagactccaaagagagtagcccccttagggttttcatactgaagaaccttgtggagtactgtgaaacattgttgaactttatgcaaattatactgcactggattttaagattttatggggagagagtagagcagagtggggaagtaatgataaaagataaatacgtaaacttgtactatattttaagcaaggaatgaaacaaattccctaacaggaattccctgtcagcactgtgaagtttggtcaagttctgcctaatgggttggcttgctgattcctcttaaacctctaggaaatcctttctaagacagcaaaacaaacgttagtttgagtactactatttcaccaccctgctccatccccctactctcaacgaaagaaaagcattcccaaactataggcaaaagaaatgtgttctcagtccattaatttttcatctgctatgatctctgttcacagttttagcacattgcattattttgtaatctgatagcagaacatcaggaactaatggcttccttccctttaagaaatcttaaagttagaacttttttttttttttttttttttgagacagggtcttgatctgtcacccaggctggagtacagtggtgcaattatagctcactgcagcctccacctcctggactctatcctcctgcctcagcctcccaagtagctggaactacaggcatgtgccaccacgcccagctaaattttctattttcttttagagacagagtctcactatgttgcccaggctggtctcaaactcctgggctcaagcgatcctcccacctaggactcctaaagttacaggtgtgagccactgtgcttggcctagaactctgtttttggcatttctttctaaatgagtacattggaagaacatttaggtttccaggctcctcataatttctgaatgggacccgctctgctctgcctctgaaaggaggagaaaaggctgagggttcaaagacagaaaagtcaatgtagcagaaatttgatttccttcagatggacatagtctgaaagaaatctatccagctgttctctatggtgcttatatgatgggtgacagctgtccccatctacctgtccctggcactgtgccttcacactggtcactgtgaaaagcagatcacactggactcagaggccagaatccaggacaagatcccccttctcatcttgagcccatcacatctttgtatagctgttaatgtagcatttacttctctatgggaaactcttgggtttttaacccaagaagaaattgtaaagcatttaaactagtcagaaaataagattctgatggtagcgatcaaataaaggaaaatttcacttcctctcagttgatattgattgatagcaaggatcaactatgcccacctcttcctaagtttctaaaggctaccataatatttgtaaacaacaaatttatctaatattttttacaacttgctaatcaaggaggattcatattaaaacagacaatcagtttctaaaatgttatccctgaaagggaatggaatagagtatttttagctgtaagaacctaccagtctgttttttccctttgaaaaaaactaatgtttgagatttgtgtcttttcatctgaagcagttactccattaatagtaaagatgcctcgggaaagtcagtgaaccagaatagtgctcttgcaccactgagggtgctagactggctttgtgcatcttatttcctaagaatatcagtttttattatgaccttaattataaatacctatatataggagtaggattttctctcacccaaccctactttaatcattatcacttaagtgtaaacctccacctccccctctttccctttaccgaaaaaaaatgcactttaattcctaaggagagtggctgttcctggccctgaaaccagattacttcaggaggagagttaaggagggagagctcttaccagaccctgtgaaatgaaccaaatttcttaatgtaaacacacaagtaataacatccacttttaagtggcccccactccatgccaaagggaaaaagaaccgccaaattgaaaaagggttctaaatacctgtcctgattttggaagtttcactggggaaaaactacctaagattattttcacagctaccaatttgtcagaaactttggtggtgttttgtgggaggctgagattttttaaattaaaaatcaagtgaaaacacaaagactctaagacacgatcctgatttgtgtcatttctaagtatcagatttgttctcccttcatttgacaggtgttctcagtctctcctcctgtaagattctgtccttcccctgatgacaagccaatagttcttggtggggttgcatgtctcctagagccccaggacccctgtcgtgtcggggaaggggggagggcaggagggtgggcagagactcgggttgggggagggagttcaaagaaagagtgaaaatatgggtttatataaacatatttaaagcagtttagcaaaagctttctcgttgaacagctttaagaacaatgtgaatgaaatcttagcaacttggttagtaatctgaaaagtctattaatgtatacttgaaattctgtttgtataaaaatgcattttcccctttattttaacactgtgtaaaagaacattatgcatgtgagtggtttgagaattaaatggtttaatactcaga

SEQ ID NO: 201019 - DNA, 1337 bp, Homo sapiens
  Payload ID: 19679
  Gene Name: zinc finger and BTB domain containing 37
  Uniprot ID: Q5TC79
  ENST ID: ENST00000367702
  CDS Start-End: 238-1323
ccacccccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtatggagttgtggatttagaactgctttggtggttggaggaattgctactgtgtatgaatagaaaataatgaaaaa

SEQ ID NO: 201020 - DNA, 2323 bp, Homo sapiens
  Payload ID: 19679
  Gene Name: zinc finger and BTB domain containing 37
  Uniprot ID: Q5TC79
  ENST ID: ENST00000367704
  CDS Start-End: 400-1326
aacctccctcaatcttcctctcatccagtatcaccttcttcccaccccttaagtccgccccttttccccgcccttcctcgccattgtgggcagagacatgaccgtccacgtgatgccgtgctcccgccctcctcccgactgaggaggaagagcagagaggggagggggcgcgagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaag

SEQ ID NO: 201021 - DNA, 2022 bp, Homo sapiens
  Payload ID: 19679
  Gene Name: zinc finger and BTB domain containing 37
  ENST ID: ENST00000432989
  CDS Start-End: 467-1702
agactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatc

SEQ ID NO: 201022 - DNA, 2300 bp, Homo sapiens
  Payload ID: 19679
  Gene Name: zinc finger and BTB domain containing 37
  Uniprot ID: Q5TC79
  ENST ID: ENST00000427304
  CDS Start-End: 277-1788
cacttccgggacggtgttccggcccattccggcccatttccacccccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaag

SEQ ID NO: 201023 - DNA, 3588 bp, Homo sapiens
  Payload ID: 19680
  Gene Name: zinc finger and BTB domain containing 38
  Uniprot ID: Q8NAP3
  ENST ID: ENST00000321464
  CDS Start-End: 1-3588
atgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttga

SEQ ID NO: 201024 - DNA, 3662 bp, Homo sapiens
  Payload ID: 19680
  Gene Name: zinc finger and BTB domain containing 38
  Uniprot ID: Q8NAP3
  ENST ID: ENST00000441582
  CDS Start-End: 51-3638
agttctcagacaggctgcccagaggggctccagcataagcaggagacatgatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttgagtggcaagaattagaaaaatcttc

SEQ ID NO: 201025 - DNA, 593 bp, Homo sapiens
  Payload ID: 19680
  Gene Name: zinc finger and BTB domain containing 38
  ENST ID: ENST00000507722
  CDS Start-End: 238-593
tatttctggagtagttgtgggagagagatgtactccaaagagaagaggactcttgctatggttcagttgaaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttctt

SEQ ID NO: 201026 - DNA, 578 bp, Homo sapiens
  Payload ID: 19680
  Gene Name: zinc finger and BTB domain containing 38
  ENST ID: ENST00000503809
  CDS Start-End: 476-578
gcatttttctacaagcctgccggcaccatttaggattttgaaaaataatctagaaatgctataccctttatcaaaattattttttactttgcaagagcttaacagttttggttttttcttagcaattctataaaattaacatctataaaatgcatcccggaccagatacatactgtattgaaagctttcttcaggaagagaatatgagagtgttctttccagcttattttcttccttagcaaaaggattgtttgattctcagaagcagaaggacacattcattgtggagcagctctgcttaagtttgaaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatg

SEQ ID NO: 201027 - DNA, 859 bp, Homo sapiens
  Payload ID: 19680
  Gene Name: zinc finger and BTB domain containing 38
  ENST ID: ENST00000510726
  CDS Start-End: 228-859
aggctgcccagaggggctccagcataagcaggagacatggagactcttgcctccatcatggaggaggttcacaccagaagccagctctgcccttggagactctcttcccccagtgctcccctgaagcttcacactcaccagtctcatgctgcaccctgaccggcaggtccctagcatgagccccataatccctggggactgcattatcacagaccagtaataagaagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacga

SEQ ID NO: 201028 - DNA, 590 bp, Homo sapiens
  Payload ID: 19680
  Gene Name: zinc finger and BTB domain containing 38
  ENST ID: ENST00000504673
  CDS Start-End: 309-590
agcgctgcggccggactcacgggtccggaagcaccatggacccccggggaaacgcgccggcggcgaaggagccgagccccatcttgatgtggaagaaatggaggactcagaaccaaggatttccaagtgatttcttccaaagcacaggaatctcactctgttaaagctggtctgttctaactgagacggagtttcgctcttgttgcccaggctggagtacaatggcgcaatcttggctcaccacaacctccgcctcccgggttcaagcagttcttctctctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttcc

SEQ ID NO: 201029 - DNA, 649 bp, Homo sapiens
  Payload ID: 19680
  Gene Name: zinc finger and BTB domain containing 38
  ENST ID: ENST00000513570
  CDS Start-End: 441-649
ctcgagtccagcgggctcgggcactgctttgacagtcacacctcccgtctcctggattgggaatcggaccctagtcctgaccctatgggaacttgatgatttccttgatgcaacaccaagcccctggaattgaaagggacgtgcaaaggcagggacctgcccccaggggtttgcagtctcagccgcctacttctgcagtagtaaggtctgctctgttggtacaacatacaacacaaccgcccgccgttagccactttttttatagggtacatcataaatcacctgagattttagtctgtccgcggttccactttataactcctgcactgcggtagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttc

SEQ ID NO: 201030 - DNA, 855 bp, Homo sapiens
  Payload ID: 19680
  Gene Name: zinc finger and BTB domain containing 38
  ENST ID: ENST00000509813
  CDS Start-End: 522-855
aggttgtccaagctggcctccctctctgctgagtgcactccagcagcttcccgatgttggcctttagaacagcctgaatttcagttaaaaaataagcttcccctgtcacacgatgccttcttgaatctgatagcttaagtgcagtaaaatctgataaatgtagcttttctgtgcccgtttcaggccacatttagaaggcaacatcaacaggattttccttttcctagacacagctcaactccataaaggacttctgttttgtaatctgttttcgagatctgatgcgtgtgtttctaacaccccgtcacgtgaggaggtctgacgtagtcacccaacatgactttgagaaaatatactgtaaagatgtgtgtgggatggtacagccagctcactgaagcaaaatatcctttgtcggaaaactttccgcagggaataacagacctgcgcagtagatttcactttgatatggcccctgtgctggcccagtatggactgcaggtttgacttttgcaggattccagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaa

SEQ ID NO: 201031 - DNA, 2659 bp, Homo sapiens
  Payload ID: 19680
  Gene Name: zinc finger and BTB domain containing 38
  ENST ID: ENST00000509883
  CDS Start-End: 347-2659
gcagtctcagaaaaaccttggatgagaaacttcttttttcaatcctgttttcctgttgataaattcagttctgtgatcacagttcattcaagctgttctgcgtatgatttttgtgtgtatgtgacaattgcatctaaaacttgtgagcaagaagacagagaaatcagttggtctccatcgctttacataaaaatggctgagtgtcttgtcatgctagcactgcattaagtgatgcatacagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagaccc

SEQ ID NO: 201032 - DNA, 644 bp, Homo sapiens
  Payload ID: 19680
  Gene Name: zinc finger and BTB domain containing 38
  ENST ID: ENST00000510338
  CDS Start-End: 207-644
attttctgggcggtgctgtgcagcgctgcggccggactcacgggtccggaagcaccatggacccccggggaaacgcgccggcggcgaaggagccgagccccatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaa

SEQ ID NO: 201033 - DNA, 591 bp, Homo sapiens
  Payload ID: 19680
  Gene Name: zinc finger and BTB domain containing 38
  ENST ID: ENST00000513258
  CDS Start-End: 267-591
aaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgaggctggagtacaatggcgcaatcttggctcaccacaacctccgcctcccgggttcaagcagttcttctctctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcag

SEQ ID NO: 201034 - DNA, 7683 bp, Homo sapiens
  Payload ID: 19680
  Gene Name: zinc finger and BTB domain containing 38
  Uniprot ID: Q8NAP3
  ENST ID: ENST00000514251
  CDS Start-End: 280-3867
agttggtctccatcgctttacataaaaatggctgagtgtcttgtcatgctagcactgcattaagtgatgcatacagatcttgatgtggaagaaatggaggactcagaaccaaggatttccaagtgatttcttccaaagcacaggaatctcactctgttaaagctggtctgttctaactgaggctggagtacaatggcgcaatcttggctcaccacaacctccgcctcccgggttcaagcagttcttctctctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttgagtggcaagaattagaaaaatcttcaaaaatatagttggtggtttttttagttatgatttaagtttagtttcattttgtccatgtgacagtcatgaaggagtgaaattaaaaaaaaaaaaaactcatttgtgaaaattccagaaaaaggatcctaatatctactttgggttttagcattaactttatgcaaagtgcacaaaaacaaaatagctgactcctccaatatcccaagtttcttgtgaaagttaataaaattcttagctgtggtatttctaccagtgaaaaaaggagtttaattttagcctagtttaaaactttctaataattgctaataagaactggctgctgaactgtctttagtcactggagaaaataagggtcagatatcctgaagatggcatcttcgtaaatatgttacgtggtaataagctgtgtgacggtctttattcccatctggcttctgcactattaaaatttgtttaaattaatggatacacatgaaatacttaaacaatataactgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaa

SEQ ID NO: 201035 - DNA, 1434 bp, Homo sapiens
  Payload ID: 19680
  Gene Name: zinc finger and BTB domain containing 38
  ENST ID: ENST00000509842
  CDS Start-End: 983-1434
cacagaagccctctagccaaggcctcgggcagccctaccaaatgaatatgggcacttgagttttctaggagggctttcctgctgccctgggtctcatccaactggtatccatctaaacattcccacccagggttattcatgctagaggaagaagaatgccctttccagagccagttcttggggaaaagaggaactgttgatatagccagagcccgaaaagaagattactctgcaacagctaaagcctcacgaaagattttacttgtagatcaactttcaaaatgtaggaagtcagaatgggtgacatcatcagaaaaatatgtggagctgatcacaagaagtgaagaacccagagcacgaaagcggttgtgactcctgggcccagggagttgacagcgtctgggtttcagaggagccagcgcctccgagttgtcttgaagtgaggctctgctgtagtcctgttcttctggctctaagatctgaatgttgtgaccactaatttgctctttcctggagagtaaccccagtttggtccacaaggcttgctgcccaatctttgccaacagttgaaccaagactctgaggctgatatgcaatgtcacttacaacattaatcagatactgcatttaaggttcacagtgtcttcacctggaatagattccacctcaagaaaccagtttctttgctcatccataagaagcaactcctcatctgatcaagttttataataagattgcagaaattcagtctcatctttaggctccacttctagttcttatgctatttccaccacatctgcagttacttcctccactgaagtcttgaatctctcaaagtcatccatgagggttggaaccaacatcttccaaactcctgatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaa

SEQ ID NO: 201036 - DNA, 6170 bp, Homo sapiens
  Payload ID: 19681
  Gene Name: zinc finger and BTB domain containing 39
  Uniprot ID: O15060
  ENST ID: ENST00000300101
  CDS Start-End: 87-2225
gaagcggcggcggcgatggtgctcggggcgccgcagagccggattaactgtgctgataaggaggtaatttcataggagctgctaagatgggcatgaggatcaaactgcaaagcaccaaccaccccaacaacctgctgaaggaactcaacaagtgccggctctcagagaccatgtgcgacgtcaccattgtggtggggagccgctccttcccggcccacaaggctgtgctggcctgtgcagctggctacttccagaacctcttcctgaatactgggcttgatgctgccaggacctatgtggtggacttcatcacccctgccaactttgagaaggttctgagctttgtctacacttcagaactcttcacagacctgatcaatgttggggtcatctacgaggtagctgagcgtctgggtatggaggacctcctccaggcctgtcactctacctttcctgatctggagagcactgccagggccaagcccctgaccagcaccagtgagagccactctggtaccctgagttgtccttcggcagaacctgcccatccccttggagaactccgaggtggtggggactaccttggtgctgatagaaactatgtgttgcccagtgatgctggagggagctataaagaggaagagaagaatgttgccagtgacgctaaccatagcctgcatctgccgcaaccgcccccaccaccgccaaagacagaagaccatgacacccctgctcccttcacgtccattcctagcatgatgacccagccactcctaggcactgtcagcacgggcatccagaccagcacgagctcctgccagccatacaaagttcaaagcaatggagacttcagtaaaaacagcttcctcacccctgacaatgcagtagacattaccactgggaccaactcctgtctgagcaatagtgagcactccaaagatcctggctttgggcagatggatgagctccagctcgaggacctgggggatgatgacttgcagtttgaagaccctgctgaggatataggcacaactgaggaggtgattgagctgagtgatgacagtgaggatgagttggcttttggagagaatgacaatcgggagaataaggccatgccctgccaggtgtgcaagaaagttctagagcccaacattcaactgatccggcagcatgctcgggaccatgtggacctgctgacgggcaactgcaaggtctgcgagacccacttccaggaccgaaactcccgggtaactcatgtcctgtcccacattggtattttccttttctcctgcgacatgtgtgaaactaagttctttacccagtggcagctgacccttcaccgacgggatggaatatttgagaacaacatcattgtccaccccaacgatcccctgccagggaagctgggtctcttttcaggggcagcctccccagagctgaaatgcgctgcctgtgggaaagtattggccaaagatttccatgtggtccggggccacatccttgaccatctaaacttgaagggccaggcctgcagtgtctgcgaccagcgtcaccttaacctctgcagcctcatgtggcacacgctgtcccatctcggcatctcagtcttctcctgttctgtctgtgcgaacagctttgtggactggcatcttctagagaagcacatggctgtgcaccaaagtctggaagacgccctcttccactgccgcttgtgcagccagagcttcaagtcagaggctgcctatcgctaccacgtcagccagcacaaatgcaacagtggccttgatgcacggcctggttttgggctgcagcacccagctctccagaagcggaagctgccagcagaggagtttctgggtgaagagctggcgctgcagggccaacctgggaacagcaagtatagctgcaaggtctgtggcaaaagatttgcccacacaagcgaattcaactaccaccggcggatccacacgggggagaagccataccaatgtaaggtgtgccacaagttctttcgaggccgctcgaccatcaagtgccacctaaagacacactcgggggccctcatgtaccgctgcacagtctgtgggcactacagttccacccttaacctcatgagcaaacatgttggtgtgcacaaaggcagcctcccccctgacttcaccatcgagcagaccttcatgtacatcatccattccaaagaggcggataagaacccggacagttgactgggtcccggcagagccacggggagctcccaagcagcagccaggatgctgatatctaagaggtgttggtccctccccagctgaagttataattttgccttggtaggaattctgttctgtgttgtgtttaaagaagaaaagaagaagaaatagcacataagctgttactgttgttgagaagcaacagccctatcacatttacctccatacctgttcttgcccatgcagggctatgtttttcattcttttgaggctggttttgggatctagtcaagcagttggtgtccactagacccccttccccagcctctctagttttagtttactgataggttttatgctgctaagaatccaaccaacagcctcacttaacagaggaggtaaagggaggttttcactgtgggtgttactgcaggcctccaactgggatgaccagcaatgagaaagattttgggaatgtgatcattcagaaaagacaggtcagcagggcagtcccctcaggttccagccctcagcagggacaagacatcagggatgttggtgtctgcttatctacagccctaatctgctgattgaacagtgaaaatcttttggcagctagatccatactaggcacagagctttctatttaggtcagaaagctttgggatgaacccctgccagccagaaggggtgtcctgcagtgccaccagaagtggcagcctggatggacaggagaggtttctcttttctcctcatttccaaagaaacaggattttatggagtgatggcccgggacgtccggccttctgtggggcagagaggatagggaaccactttgatatagtcatctgttttggccacttctgttggccatgagtgtcttggtggagaggtggggatgtatctgacagcagcagccttgccttaatttatatctggtctcccgtccagaagtgtttggcccgtggtgtagatgagctgactccatgaagtggtggagtggcagaccgcgagcccttcaggattaaagggacctgagtaactggtggtgtgtagcagggtgtgcgttctgactgtctgtcctagtcgggtaacctgtttactttgtgctaacagtgccggagctttgtcagctcacctttgacctgctggaatttatcctgatctgtcgttgccatcacctccagggggcgctattggatggcagctggttcaggccctccgtgggtggctgcagagtgtgccggcacagcccacgcagctggttagctccactcttacttggttttctaaggggctttgcccaaagaagtcttgagggatagggccctcgatcttgcatacttgtgaggtgccacctcagtagctcatactacctcaccctgctcaggtgagctctgggagtccctggcctcagccctggcactgcccctggtgggattcagcaacaccccgggctgtttcacaagcaagtggttttcattaactcacaaagcctttttggacattaatatttatttatttttgtttttgtatacacattacccagcatctcttttgtataagagactttaggaaaatgagtttctccccagcaagtagccatattccagagaacagccttgaccagagatgtggagaaccaggggtataactaagggaagacatgtcaagcccttaagcaaattcttcttctccagattgtctctagcataataaacccagggaacactttaggccatgggtgtatgttctataaagttcgggacagttaaattccaggcctttcatcccccttccttcctgtgatggagtagattggggacagggttgaggggaacaagtgacatgaatgacctatttgcacagtttggaagcctcctgtctttatttatattgagatgtcagacaaaccaaagctccatccttgttggacctgctgcttctccccagccctgaactgataaagcctcagagttggagtgcctggctctctggtggggtgaccattagatgaagggacttgtacagtggccagtttaaaggtccacctttgaccatctaaacccaccttgttcagtgtcctctgaggacatcctcatcaggaaagcagtgttgagactcttcattgctgactggcttctccctttcttactcacactgaccattagaatttaagaaggaaatgtgtaacagactacagtcaagtgtctgctacattttcaagcatgagcaatccctcccagactgttggtgaggactgatttttgaaatgctggtgtgagagaggtggtaattacaggaaccagccgagtggctgagagcagataaatgtgctggagaaacctttttccttaacagagggcatcatggatgctgggtggtctgtgtacttaacctgaaactgtgaagttttccctttttgccagtaaaccaaaaagcagatccttgaaacttggcccttgaaacacgaaacagaaaactgcatcccctgatcccccgggggctgatcagattgatcagggtggctcagttggtcccagtcagatacgtcataggatcagtagctcatgagatttgttgaccaaaccctctccctgttggtgacccctgtattcacacctgaacttcccgtttccccccaccccaccaaagtcatgtctgcttcctctgcctccagctcaccctcttctgaatggttttgcttgaaacactatattgtggcagagggcaccctgggatacctggtagaaggtattcattttattttgcatttttaattgttttgactttctgttcatttgattttgttgctccctctctcctggaacctagtttactactctcttctgtgttactctgaagttctgtttaagccttgaacatcctcttctcccattttcttggtatgtactcaggaccagctacatcatttgtggagccctcttattcataaattattaaaaatttcaaggtggtggtcatagagcattaaaccaaatatgaggccattcccaacttgttttccgaggggaaaatggtaatacttgtgtggcacccggggttaaacagcagaggctccatgtggccagaggcagagattagtatcctggcactccagtgacccactgggtgactcactgatgccacagcacccgctaggaagctctgctgaaccttagtatttggtcctaaattttatgactccatggagttcccgtagtccatggctagttaggaagaaaggaggtgggataagggtcaggcccaggtgacccctaagaaccaggagatgggtaaaagtttttttttatattctgcttttctgatctgtgagtacctgtttgtctccaggccaaacctttgggcttaaatatctttttcctagacaggtttttgctagtgttgaattttcttcttcctctggcctccttctgtgcccctttccccaagcccaagactgcttaacttccaaagcaaattctagatagacactgtatttattggtatgggagtgggctctatggggtggtctgcacccatctgggactcttttccctaaatcctgcaccaaatgagtcaggaggcagggtgcacagcattagtttcaatgtggttatgcatcataagcttaacatcagaatgaaaatgaaactcgattttgatgtttctttaaaacccttcccctgtccaatccactcgccgcccccaccttgaatagctaaagtctcttatgaaacagagaagagttgttgacgtctaactccttccattaaattaataagtactgacctcctaatatttaagtgtttactatctattgctgtaaagttttgtatattttgtaaacttttttccccaaatagtagatgtctaaaatcattgtacatctgattcttttatattccattgttcagcacaaagtgtggtttttatttagaataaaaaaagaaatttgaaatg

SEQ ID NO: 201037 - DNA, 5956 bp, Homo sapiens
  Payload ID: 19682
  Gene Name: zinc finger and BTB domain containing 4
  Uniprot ID: Q9P1Z0
  ENST ID: ENST00000311403
  CDS Start-End: 341-3382
aaggggtgcgagccagagtcgtgggtaaaccccccgctcgctggttgggcgaccttttgaagtgacagggagagaagaatttttttctttaatcccaccgcctctcctcgctgctcccttttgcactgaggcttaaggtttgaagactcgagggtaaaattgggccgctttcattctagtttggacaacggtttcatcttcagcaaaagcctctcattcgtagccccccccagctggaaaatggtctgctctgcgaatcgaaggaagaggcccagcagaagggactcgctgagccaccccccgccccactccatgttggctgtgctctcaggctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaagtcccttcttcagagaggccctgctcacttcagccccactaccccttccaccagctactgggggcgccgcacccaaccctgccaccaccacagctgcctcttcctcctcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccaca

SEQ ID NO: 201038 - DNA, 5866 bp, Homo sapiens
  Payload ID: 19682
  Gene Name: zinc finger and BTB domain containing 4
  Uniprot ID: Q9P1Z0
  ENST ID: ENST00000380599
  CDS Start-End: 251-3292
gtcagcggcggcggcggcggcggcagcggggccgggccggggccaggcgctgggggggccagggccggagctggagccggagccggagctggaggcgggcaaaaccggagcggccgggggcggccacggtgatgagccgggcctggcggacgcggcgccatcgcagtcagaaggaagaggcccagcagaagggactcgctgagccaccccccgccccactccatgttggctgtgctctcaggctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaagtcccttcttcagagaggccctgctcacttcagccccactaccccttccaccagctactgggggcgccgcacccaaccctgccaccaccacagctgcctcttcctcctcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccaca

SEQ ID NO: 201039 - DNA, 8368 bp, Homo sapiens
  Payload ID: 19683
  Gene Name: zinc finger and BTB domain containing 40
  ENST ID: ENST00000374651
  CDS Start-End: 224-3607
gatacccattgcgcgccggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggaggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtacaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgccaagaagagcttcatctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaagtc

SEQ ID NO: 201040 - DNA, 8685 bp, Homo sapiens
  Payload ID: 19683
  Gene Name: zinc finger and BTB domain containing 40
  Uniprot ID: Q9NUA8
  ENST ID: ENST00000375647
  CDS Start-End: 208-3927
cggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacagaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtacaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgccaagaagagcttcatctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaa

SEQ ID NO: 201041 - DNA, 1855 bp, Homo sapiens
  Payload ID: 19683
  Gene Name: zinc finger and BTB domain containing 40
  ENST ID: ENST00000400239
  CDS Start-End: 496-1855
cggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagcaaaagtttactgacccctgccctaaacacaaggagattggatcagtgttgtcattcagctattcctctcgtcggttcttctggagtgggaaaagagttaaaactgcgcgatgcaccgagagcactttagttgacagaacactctggcttcccttctggtcttactgactattcagagtttctcctgctttgaatagcgttggtaccatgcagccagtgctgcaatgaaccaggtgctttatttatattcatacaagtgttgttctactttatgacgacgctttataaggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacagaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacag

SEQ ID NO: 201042 - DNA, 8992 bp, Homo sapiens
  Payload ID: 19683
  Gene Name: zinc finger and BTB domain containing 40
  Uniprot ID: Q9NUA8
  ENST ID: ENST00000404138
  CDS Start-End: 512-4231
gatacccattgcgcgccggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagcaaaagtttactgacccctgccctaaacacaaggagattggatcagtgttgtcattcagctattcctctcgtcggttcttctggagtgggaaaagagttaaaactgcgcgatgcaccgagagcactttagttgacagaacactctggcttcccttctggtcttactgactattcagagtttctcctgctttgaatagcgttggtaccatgcagccagtgctgcaatgaaccaggtgctttatttatattcatacaagtgttgttctactttatgacgacgctttataaggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacagaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtacaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgccaagaagagcttcatctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaagtc

SEQ ID NO: 201043 - DNA, 8478 bp, Homo sapiens
  Payload ID: 19684
  Gene Name: zinc finger and BTB domain containing 41
  Uniprot ID: Q5SVQ8
  ENST ID: ENST00000367405
  CDS Start-End: 70-2799
atctagttttcctttataaatcacttaagacacttatgaagtttcttgttctgaaattgctgtactgcaatgaagaagaggagaaaggttacttcaaatcttgagaagatccatctaggctatcataaagattcttcagaaggaaatgttgcagtggagtgtgaccaagtgacctatactcattctgcaggaagaccaactcctgaagctcttcactgttaccaggaacttcctccctctccagatcagagaaagcttttaagttctttgcagtataataagaatttgctaaaatatttaaatgatgataggcagaagcaaccatctttttgtgatttacttatcatagtggaaggaaaagaatttagtgcacataaagtagtcgttgctgtcggcagtagttattttcatgcgtgtttgagcaaaaatccaagcactgatgttgtcaccctggatcacgtaacacattcagtttttcagcatttgcttgaatttctttacacatcagaattttttgtgtacaaatatgaaatacctcttgttttagaggctgcaaaatttttggacattatagatgcagtgaagttgttaaataacgaaaatgttgccccttttcattcagagctaactgaaaagtcatcaccagaagaaacactaaatgaattaactggaagactatcaaataatcatcagtgcaaattctgtagtagacatttttgttataaaaagtctttagagaatcatttggctaaaacccataggtcccttttattagggaaaaaacatgggttaaaaatgctggagagaagtttctccgcaagaagatcaaaaaggaatcggaagtgccctgttaagtttgatgacaccagcgatgatgaacaggaaagtggtgatgggtcagacaatttgaatcaagaaaattttgataaggaaaagtcagatagaaatgattctgaggaccctggaagtgaatataatgctgaagaagatgagctagaggaggagatgtcagatgagtactctgacattgaagaacaaagtgaaaaggatcataatgatgcagaagaagaacctgaggctggtgattctgtaggaaatgttcatgaggggttaactccagtggtcattcagaacagcaacaaaaaaatattgcagtgtcctaaatgtgataaaacatttgaccgaataggaaaatatgagagccacacccgtgttcacacaggtgagaagccctttgagtgtgatatttgtcaccagcgctattcaacaaagtctaacctaactgttcacagaaagaagcacagtaatgaaacagaatttcataagaaggagcacaagtgcccttattgtaataaacttcatgcaagcaagaagactttagccaagcatgttaagagatttcatcctgaaaatgcacaagaatttatttccattaagaagactaagagtgaaagttggaaatgtgatatttgtaagaaatcttttactcgaagaccacacttggaggaacatatgattctacattctcaagataaaccttttaagtgtacctattgtgaagaacattttaaatcacggtttgctcggttaaagcatcaagaaaagttccatctgggtccttttccatgtgatatatgtggtcgccagtttaacgacactggaaatttgaaacgtcatatagaatgtactcatggtggaaagagaaaatggacttgctttatctgtggaaaatcagtacgagaaagaactactttgaaagaacatttgagaatccacagtggagaaaagcctcacctttgtagtatttgtgggcaaagttttcgtcatggaagttcgtatagacttcacttacgagtacatcatgatgataaaagatatgagtgcgatgaatgtggaaaaacatttatccgtcatgatcaccttacaaagcacaaaaaaatacattcaggtgaaaaagctcatcagtgtgaagaatgtggaaaatgttttggtcgtagggatcatctcactgttcattacaaaagcgtacaccttggagagaaagtgtggcaaaaatataaagcaacatttcatcaatgtgatgtttgtaagaaaatttttaaaggcaaatcaagtctggaaatgcattttcgaacgcattcaggtgaaaaaccatacaagtgtcaaatttgcaatcagtcttttagaattaagaaaacattaacaaaacacctggttattcattctgatgcccgacctttcaactgtcagcactgtaatgcaacatttaagcggaaagacaagctgaaataccacattgaccatgttcatgaaataaaatctcctgatgatcctctcagtacttctgaggaaaaacttgtatccttgccagttgagtactcatctgatgacaaaatctttcaaacagaaacaaaacaatatatggaccagcccaaagtttatcagtcggaagccaagacgatgttacagaatgtatctgctgaagtatgtgttccagtaactctggttccagttcagatgcctgacactccgagtgacctagtgcgtcatactaccacactcccaccatcttctcatgagattctgtcaccacagccacagtcaactgattatccacgagcagcggatttagcttttctggaaaaatatactcttactcctcaacctgcaaatatagttcacccagttcgacctgaacaaatgctagatcctagagaacaatcttatcttggaacattactgggccttgatagcactactggtgttcaaaatatttctacgaatgagcatcattcatgagtaaatctaaacattccacagatttttggatggttatatgctaatggtagagatgatagcttttaaatttgtggggctgctattttcttgttttctctagtttctcaagtcctcagaacagtttcaaatcaagaaaactatgtgtctctgtttactgaacatgaatatttggacaaaatttctggcataatatttgaagtgcacatttttgtgatttttaaagattatttagtgctaacttttaatggtttcttaaattttttgcaattattagctgctgatattatggaagtattttttttaatcatcagtggaaatttttattcttctttagtctcattcctctccttcttcttcctagcccttcttacaaacaagtttgaggaccatgtagcctttaagaaggaattaagagtacactgataattgcaactgtttcttatcctaagattcaatattacgttatacaaatttttaaaattgaaattaggaatttgaatttacaagaatgccttggatatttctgtgttgtctttccattcatacataattttaggttatcattatcctttggacttttgatatactcaaagccagaaagcttaactaatgtaagattagctattatttgtaggactgaaataataatccagataattggtttttgcctatacttcaattgttatgaataagaaaggcaaacataggtctgggcattaaattatacaaactgaaaatgtgttacaagaaaaatatgagagttttaactagatgtttttcaaggtaagttcaccttttgtactttactatttatttcagaaatgttgacaatacaacatagcatatgtcttcatctcactaagaaaagagcagttgtaactcaatgaaatttaattaaacatgctacttttgatttcatttacttggctgatagaaactctgggaaacagaacctagatattttgtgttcaattgttagaaaaggtgccaaacagattatgaaatttgtgcctaatttaacttaacattgtttaattaaatggaaccactacttatatacagatttacatgcaatccagatctttaattttgccttcacaaaagcctaatgtctgtaattaacctttaatttttatttctgtatgagacaaaagttgaggacttggtgaaaggaaatagcagttacagcaaaacctcagtgattacaattgaggaaaaagtcaaaattataaaatacctttaaagacatgcactttccatattttcaagtcaattttaactaaaaactaagataatgtttcctagtagagttgcttgaagattagactagacagggttgatttattattagcatgtcatttgtacataaactagtagaaaatagcagttttaaaagttttctatttcagttttgtttacactcctaattgctttaagcactttttttgtgtgtgtaaactgtaaagtctagcccagcccttgtgaaaaaaaaaatcacaaataaaacagtgaagttttaatgaataaagtttaatcaattagtaatggcggaaactgtcgctgaagcacttaagaaataaaggtactttacagcaacattcgccatactagcggaggtaaaacaaaagaaatattgaaaactgaggcagttaaccaaagtagctcatataaataataaaaccaatctgagtttagcctcatttgtcaaggtttggttgtaattgtcttaagactagtggacatacttactatgttctcctttttaaagtattcttatttctttgtgtggaaatgttatatctggggtacttacatgattgaggttgactatatgaggtactgttagtctgttagtctttcaaattgacttttaaaaatacatatctttatgattttcatcataaagactggcaatattataactaaaaatcttactataatgaaagaaatcatacataaaaatgtagcctgccttacatataagctaatgtagaaaagtttagacttataaaaaggcagatagtatatatatatttatatacatgtatgtatatggtatattatacatttggtggcagaaaaagaagatactgcattttcacattgaaaagaatactttgatttttgaaggtatttactttagggttcttttaataataatgtccgtcctaatgctttaaatatatgatttaattgtaggaattggtttacacagaacttttttggaatacatctcttagtaaagtgaaatataataatataattgtatttagttactattgtagataacttaaacttgagtagtgatttactgttttataaaatgctttcatatatgttatctcatttgaacctcataaccagccctgaaatagtaaaaacaagctatattcccactttataaagaatttgaggttaagataaaaggactcatttaagctcacatggtcagtaggtggcagagctactagtagggaaagaagaaagctagcattaatgaatgcttactatgtgccaggtactacatcctgtcatttaatcttaacctagtctgggagatgcgtaatataattctggtgaagtaatagtttcagtggatgattgaaaacaacaacaacaaaaacaaaatgaaactaatctgctgcctctaatttccaaaaatgtaagaaattttacaattgtgaaaacctcatggatttgggcaaactgaatgtatataggcttttgacaaaagttggcacaaaaagtataaaaggaggcctattcttttcagttgaccttttgtaatatttgatttagagtattttggacaaatgctctataactctaatccatttattttgtaactgtacttaaaattttgaatcttgcaactaagtttagcctcattcagaatttttttattttgtgagcataatttattgttttaaattaattttttagcagatagcagttagcacttaatctgtaaattgaataatttatcaagtgcaggaatgtgttaatctaatgggttttgacttaaatgcaccaaagatttttagtaggtattaaatagtttaaaagactttaaattctttcttgcttgaataactatttgtccaaagaagcacagttgaagtcctagaataatggatttttttaaaaaaaaaaagttgttagtttgaatactgagattgattattgtgtttatatgtataaaaataggagcaaaagaaaatactctgggaatagtcatactgacaaaccaattataagtgagaatactgttttccttagtttaattaatacaatgttatgttttttagagaacactactaaatgctaaataagcctattttttacactacactatcaaaataatttttgccttcgaatttttttaagtcaagttgaggttatttttgtaagaaacccaacctattttttttgcagcctaaaatcccatttaaggttaggggttggtccttatgccagcaagatttaaccaactgtaaagatagtagtctttgcatacatttaagtaattaaggcatttattgctgggagaataggagtagcaaaaatatggttttaaattggtgctttattaggtgacttccttttaggcgatggcaggtcatgaaataggtacactaataattttctatcaaccttaaaaagtgtcaaagcatctttgtagggtgactctaaactgctaattaagggttaataagtaattatcattggttgcttttcaatataattgcaaacaaattaaaaacacagttaaactaatatgtttataagcttgagttttcttcctaccatatcactctcatatatcagtgatgaaatgtcagattttgagcagtagctctttgacagtgtccttttatacccagtcttttctgcattgaatgctttgtgccttttcgatgtgttgtagttgcttagagttgattctgctggctagattgtactgattaatagatttttatttttatttttttttggttatgggtgttatgattgtgttgcctgctggttgggcaactttttttttttaggttgctttatgtttatataggcaaattggcactaagtgttagtgtgaatatttgtttttatgatttatatatcattttaaaaatctctgttgtggcctttatagttactgtgaagccactcttgggcctgtctctatatgcttattagaggaatctgacaagtaaaataaaatgagtagtgtgtctgcatctgtgtctctgtttctctgtcttttaaataaccagtaaccataactacacagccctgcactgaatgaccttatttcagtttgcctaaaactgaacaagaggtgatggtttgagatgagtttctcattaggagcagcaacatcccaaccaatatataatgagttgatcaactcaggaaaaattaggactttaaagaaggttgtatttggatattctaagattcagtgccaaatttaaaatgcctagaaatgtattctacaagtagcatttctaaaactttaagtagtgttatagtaaatgctacttgctgttagagtgaataatggataatgtgagaataattttctaaacgacttctagaaactagacagttcttccttatatcctacccttttccacatttctctaatgtggggttttttgtttgtttgtttgttttgagggtagagggaatcccctccttatttcctctaaaattgtttttacttaagataccttttccctataatcttagcatgctttctgctctttctctttggaagtagcattaataagatagatgtaataggattaagatgtgtggaagatgagaaaaagaaggtttttgtagagagagtgcttatgttttgtttactcatgtttcaacttgctgtgtatgatcataaatctatgatcttgagaaaaatcctaaaacaatttaaatttagcctatgcagccaattacataaagagaaattaaggattatattcagaggagaaattaaggattatatttagagcacagaggttatacaaagaatataaccttgtttggtcaaattcttaggtaaagaaaagtaatcaatgcttgcattgctgttggagattctaaaagatgtattgaatgaagaggatgtacacatctcattgttactgcgtatttttttgcttggtattcctgcttgcattaaagctggacaatgtactgtgatgtaattacaaaatttttattccttctaacgattgaactcttcttatccctattgataaaactgtattacaattgatgagtgtggctgccagaaaataatacaaaactgggcatttagctgttccacattgtgtagtaaatgttttgattatggggatttacagtgtatattaaagtagaaatgcttttgcacttgttttcagtctcaaataataatttttgtttttaattaaggatactttaaaagcaatgacagaaaaatctaaaatatcagaattaattattgtgaactgtgtgtaaaatatcttgtgagttttatacatactttggttgtctgatgtttcctaagtataaatgtctttatagaaaatttcagttctctgtgaagagtaggaagtgtactgtatattgaactagttctttgtgttactttgatatttaaaataaatataaagttctttggtcctaata

SEQ ID NO: 201044 - DNA, 3800 bp, Homo sapiens
  Payload ID: 19685
  Gene Name: zinc finger and BTB domain containing 42
  Uniprot ID: B2RXF5
  ENST ID: ENST00000342537
  CDS Start-End: 286-1554
tgaagttcaggagcgcccgggcggggacgcgcgcaggtttgcgcggctccggctcctgcgcctgagtcccgggacccgcccccgcggcggagctgctactgtttactttcgatcgagtttttcctgctcggggcaggtgcccgcggcggctctggacgggaggttgcgcgcgtcactcccgcgccgctctttccgcgctgcctgcagccgggaagggcgcttcgtgggcgcctccaggcgcgctgacgggcgtcccgtttgtgcccaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctgagggtggggtggaagggaagggatgggccctcccaggtgggacacagcatggggtgtgaagcctgaccaggtggaggtccctgcttgggccagatggctccaccctcctggcagagagaatgctgcctcttcctggaacttggcctcagactcggtaacttgggcagccttcctcccaccttgcctctcctttcccctcactctccaactcattccggcccccaggctgtgccctgcctaggctgtgacactatcttcctctcccgtcccctccagccaagttctgaggggtgtccaaccagcacctggctctgcccccgtttctccgtgtgagatggcacatccatctcccggcccgggactttcctgaccacctctctggcaggcttggggaggtcttcatgagcctggccccacgctaggtgaattattcacatgtcagaaaagttgttggtgtgcgtcccaatggggcgctgggagggaacaggacactcctggggagcggcagcaggaacccctgccaggaaggcctggggcacagtgagtgccagcaggggccatctgggcacagctggtgtctcggggtgggggggggggtgcagccccagcagggatcctaaggcagcaggagtagagccagctagaagctgagtggctgtggcatcattgtcactcgggtgggacgtgggtccatgagagcgtgcaattatgaccacactgtaactttgagcagagaaagtgggaatttggaactggattctctttagagccaggaagagcctcctgaggcggccagatgtctgctggtggccgcccagccacatgcttgtctgcctgagtgcaggtctaggaagcctctgggcatcccccagggtggggtctgggccgctgagctgtgtgctgctgctgggccaccgtgggccttaccttgacggtcactctgcctgctagggggtttccctggagctgtgggcatttccgtgcactgactgagcagaggcaagggctgccctgtccgccaggggcagggtttgcgggccttcctttccccacggcgaggcatgggtgaaagtggccatggcggcagggttaggggcaggtgaggagtgggagtcgcagcaccctaggggcctccatccgcagccttgggagactgacgctcctcgaacatgaatagaatgtggagaccacaacccccacacatgtcgttggttcaggtcgccctgctttgcctgcctaatggagcacatcttgctgccagaacctcactggcctctgggggtcggcaggtgcagagccacctggacgcctggagaccacctgggatgtttcctctgtgactgggaatggccttgacaacagagtccagccaagtctacgttattttctcatctcctgacaacactggatgtcatatttattagtcagcctggtctggagtgaaagaccgtccctagcgcatctcccacgcgccctgggctcctggtgtgctgggtgccagcctgggagcccagcgcttctgggtgatgccccagggctcagaggccctggatggctttggtctcgagacagctgggggaggggccctgcttctgattgtcctgggccccagcccccacctctgcaagggatcggtgtgatgtgctccataatcgggtggggggtgtgtgtgtgtgtgtgtgtgtgtgtatgtatgcatgcgtctggcacatggcaaggcccaagccaacccggcaccccgtagatgggcagctacactgccacccaagcacggagatgtggccgcggcactgggtcccccagtgggtcccatgggggaagaacttccctttgctggggtgggcagcctgccctgagctatcaacactggatttgttgtcttctgcacagctactgtgaagataacgtaaggagaagtggtcagttttcattttataactgacacagttgggacaaaatatatacgtgtacatatatttaagacactaattgtgtgggagagtttagtagaggcctgtgcagacacaaggcaaacagcgtcagcagcgtgggggtctcctgggccagctcggcacctgtgggtgctctgaccctgggggtggggacagctccgtgctaaccccagcagacagttgttggtgcacagtgtctaggaggcgtgggaatgggtgctgtcttcctcttttcacatcatggcgacagtaataaagcccacctccagtggaaa

SEQ ID NO: 201045 - DNA, 1411 bp, Homo sapiens
  Payload ID: 19685
  Gene Name: zinc finger and BTB domain containing 42
  Uniprot ID: B2RXF5
  ENST ID: ENST00000555360
  CDS Start-End: 123-1391
ccctccccgccggggcgcgctgcccgcagctccacgcgcgccagggccgccctggggagggcgcgcgcgcgagcggcgaccggagaggagctcggggcggcggaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctga

SEQ ID NO: 201046 - DNA, 5695 bp, Homo sapiens
  Payload ID: 19686
  Gene Name: zinc finger and BTB domain containing 43
  Uniprot ID: O43298
  ENST ID: ENST00000373457
  CDS Start-End: 1102-2505
tgagaggatcacctgagcccaggagtttgagactacagtagctatgatggtgccactacactccagcctgggtaaaagagtgagacctcatctctttaaaaaaaaattctgccaggagcggtggttcatgcctataatcccaacactttaggaggctgaggctggtggatcacttgaagccaggaattcaagacgaacctgggcaaaaagtgagacccctgtctctacaaaaaaaattaattttttaaaaaaactagctgggcagctggcgtggtggctcacacctgtaatcccagcactttgggaggctgaggtgggtggatcatgcggtcaggagttcgagaccagcctggccaacatagtgaaaccccatctctactaaaaatacaaaaaaaaaaaattaaccaggtgtagtggcgggcgcctataatcccagctacttgggaggccaaggcaggagaatcgctcgaaaccagaaggtggaggtggcagtgagccgagatcacaccattgcactccagcctgggcaacaagagcaaaactctatctcaaaaaaaaaaaaaaaaactagctggacatggtggcatgtacatacagtcccagctactcaggaggctgaagcaggatgatagcttgattacccaagagttcaaggctgcagtgaactatgattgtgccactgcactccagcctgggcaacagagcaagaccccatctcgtttaaaaaaaaattatattatttgaatgggtatcttgtttgttttaactgtaaatatttacagtacttggttttacttgggagatttgtatagcttacaaatcttgtccctatggattcagttctcttacccacagacacagaaccaaaatcaggagttccacaaggagtggtggtgagtcctgcctttggcaaacacgcacctgcaagctttgctctagggattgaatcccttacccagtggggcccataggctagaggactttgtggaactttggaacttgtcttaacaatggaggaggggataaaataagtttatctttgggctggaatttgtactaatttttctttctcttgtagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctc

SEQ ID NO: 201047 - DNA, 5965 bp, Homo sapiens
  Payload ID: 19686
  Gene Name: zinc finger and BTB domain containing 43
  Uniprot ID: O43298
  ENST ID: ENST00000373464
  CDS Start-End: 265-1668
tttccgggggctgaaggcacaggctgaatctgttgcggcagctgaggctacaacaggcctgcgccggcggcagagaggatatcttgggcgggggatgtgagcgctgagcccttggcagaagtcaatgtgattttaatttgaagcaaaactgaaatgggttcttcttcctcattctattcatgttgctttttgatggccatggcataaggaactctatcccaggaatacagctttgcattagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaa

SEQ ID NO: 201048 - DNA, 5851 bp, Homo sapiens
  Payload ID: 19686
  Gene Name: zinc finger and BTB domain containing 43
  Uniprot ID: O43298
  ENST ID: ENST00000449886
  CDS Start-End: 151-1554
cgggaagcgtttccgggggctgaaggcacaggctgaatctgttgcggcagctgaggctacaacaggcctgcgccggcggcagagaggatatcttgggcgggggatgtgagcgctgagcccttggcagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaa

SEQ ID NO: 201049 - DNA, 710 bp, Homo sapiens
  Payload ID: 19686
  Gene Name: zinc finger and BTB domain containing 43
  ENST ID: ENST00000450858
  CDS Start-End: 124-710
acaggctgaatctgttgcggcagctgaggctacaacaggcctgcgccggcggcagagaggatatcttgggcgggggatgtgagcgctgagcccttggcagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcc

SEQ ID NO: 201050 - DNA, 2781 bp, Homo sapiens
  Payload ID: 19687
  Gene Name: zinc finger and BTB domain containing 44
  ENST ID: ENST00000357899
  CDS Start-End: 274-1986
cggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcagtgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcaga

SEQ ID NO: 201051 - DNA, 3951 bp, Homo sapiens
  Payload ID: 19687
  Gene Name: zinc finger and BTB domain containing 44
  ENST ID: ENST00000397753
  CDS Start-End: 295-2007
cactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcagtgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgttcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatgg

SEQ ID NO: 201052 - DNA, 3848 bp, Homo sapiens
  Payload ID: 19687
  Gene Name: zinc finger and BTB domain containing 44
  Uniprot ID: Q8NCP5
  ENST ID: ENST00000445008
  CDS Start-End: 295-1698
cactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagggcatcccaggaaatcagcttctagatctagctctgccactaactgctgttgattaaacctgtcactttacacatgaaaaagcttgaaacttagagaaagataaaattgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgttcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaa

SEQ ID NO: 201053 - DNA, 2629 bp, Homo sapiens
  Payload ID: 19687
  Gene Name: zinc finger and BTB domain containing 44
  ENST ID: ENST00000529982
  CDS Start-End: 1-986
ataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaa

SEQ ID NO: 201054 - DNA, 9315 bp, Homo sapiens
  Payload ID: 19687
  Gene Name: zinc finger and BTB domain containing 44
  Uniprot ID: Q8NCP5
  ENST ID: ENST00000525842
  CDS Start-End: 369-1730
cggctcccgggccccctcgctcctcccctctggcccctccgagcgctgggggtgcttccctccccgcctcctcgcactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatgtttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaa

SEQ ID NO: 201055 - DNA, 2179 bp, Homo sapiens
  Payload ID: 19687
  Gene Name: zinc finger and BTB domain containing 44
  Uniprot ID: Q8NCP5
  ENST ID: ENST00000530205
  CDS Start-End: 17-1441
gaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttc

SEQ ID NO: 201056 - DNA, 539 bp, Homo sapiens
  Payload ID: 19687
  Gene Name: zinc finger and BTB domain containing 44
  ENST ID: ENST00000528448
  CDS Start-End: 1-539
agaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaag

SEQ ID NO: 201057 - DNA, 3085 bp, Homo sapiens
  Payload ID: 19687
  Gene Name: zinc finger and BTB domain containing 44
  ENST ID: ENST00000527478
  CDS Start-End: 1-1786
aacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcc

SEQ ID NO: 201058 - DNA, 2207 bp, Homo sapiens
  Payload ID: 19687
  Gene Name: zinc finger and BTB domain containing 44
  ENST ID: ENST00000615689
  CDS Start-End: 371-979
gggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcggtcagtactaacatagcatttcgttacctcttaagggttgtgtttacaactccaaattcaagcatttcatctcaagagttgtagaagtttattacaacctcacttcagtatacttttcaaagtaatgaagtagcatcatcacattataaattagagtacctatacaaggcttttttttttccccagcatttccaaaactacctagtcccattgctttaaatcgtatctgtaccaagtgttggcaaactatgaaccacaggccaattccagcctaccacctttatttgtaaatcaagtattactggaacacaaccaggctcatttgctgacatattgtttgtggatggcagagttgagtggttgaaacagactgtatggtgtgcaaagtcagaatgtgtgctgtacggactgctgtgaaaaacatctgccaaagtctgatctgtatacccataactccctccctgcttgatatttccacataaatgtataaagggcatttcacatttaacaaggccaagacagaactcttgatttctaactccttgtctgaatcctgcttctccagcctttctcccatttcagtaagcatcatcattatcccctaatttctcaagcaaaatctctgaggattgttcttaatcttttttccttaccactcttcatctccctcgtagttaatccttaagtcctgtcaactctgcctataaaatatatccctgtctacttttctaatctgtactgtagccaccctactctaagtcaccaccatcttttgccttgactactgcaataaccttcaaagtagcctctgattgcattcttcccctaatccattttccatgtagcagccaaaatcatcttttcttttttaattaagtcagattatgtcactgttttaagctatagattcttaacattctttattcatacctaaaatctataggccttgctatgccttctaaagccctacacgatatgacttctgcctaactccgtctc

SEQ ID NO: 201059 - DNA, 2352 bp, Homo sapiens
  Payload ID: 19688
  Gene Name: zinc finger and BTB domain containing 45
  Uniprot ID: Q96K62
  ENST ID: ENST00000354590
  CDS Start-End: 293-1828
gtggggcgcgggcaatggagcagagtatgggagaacgcgctcggagtaaagcacacggcgcggcgaaggcgtggcgggagtgtgcggcgccggacccgggaagctggcctgggcgccgggtctcgagtgcaggcctttgttctgaagtgtccaggccggccttgcggcgtcgggactgaggaatggagcccgtcgcggggcggggcgggaaaggaaggttcaagtctctcgggttgatgcgcaagtttccgtccccatcggccggacagattagaatcctttcaggtgctagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaa

SEQ ID NO: 201060 - DNA, 2541 bp, Homo sapiens
  Payload ID: 19688
  Gene Name: zinc finger and BTB domain containing 45
  Uniprot ID: Q96K62
  ENST ID: ENST00000594051
  CDS Start-End: 482-2017
gcttgcacctcctggcggccagggaccgagacctacttcagctctcacccgtgtcacaggaataaggccacttccccggttcgcagtggggtttaaactggccagaacacgttgggcacttgggccgggaactgccttcccattctgcatcacagggagcttgcggattgatcgcgcaggcccgccacacccctgatctcctgggcgacgccggaagagtgctctggtccagacattcctcgcgacgcggcagccctagcctcttcgactttggttccgactaagaggagagccggagtgcagactggcgggagctgatcgccataaaaataccggaaacgtgcttcggcctagggtttcccctgcgccgccgcgaccgcaggcctccgttccgccggggtaacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaa

SEQ ID NO: 201061 - DNA, 576 bp, Homo sapiens
  Payload ID: 19688
  Gene Name: zinc finger and BTB domain containing 45
  ENST ID: ENST00000600130
  CDS Start-End: 212-576
gttgaaaacgtggtgggtgggtgcattgaggctggccccgggggggtgggcctcagccccctgtgcggtgcccctggggtcgtgaggtctccggtccaggtgacaacggctgggggcggggtaggtggcagcttccggaggatgtttggaggccgcgaggactggcgcgaacaaccatgaaacccattcgccactcccaaggcgcgcacagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattat

SEQ ID NO: 201062 - DNA, 592 bp, Homo sapiens
  Payload ID: 19688
  Gene Name: zinc finger and BTB domain containing 45
  ENST ID: ENST00000596739
  CDS Start-End: 542-592
gtagggtggggcgcgggcaatggagcagagtatgggagaacgcgctcggagtaaagcacacggcgcggcgaaggcgtggcgggagtgtgcggcgccggacccgggaagctggcctgggcgccgggtctcgagtgcaggcctttgttctgaagtgtccaggccggccttgcggcgtcgggactgaggaatggagcccgtcgcggggcggggcgggaaaggaaggttcaagtctctcgggttgatgcgcaagtttccgtccccatcggccggacagattagaatcctttcaggtgctaggtgaatacagatggggcggtgctgcttgctgagttagcctttgcgcgggcacaggcctggcttttttgaggcattgcacagaaggctcagaacagggccagggagcggggtggtgtatccggatccgtagtctggaaaagctccctctggctgccgtgtggggaacagaaggggaggcgaggggcgcagagacaccagccaggtttcttcatccgtccaggacagcgggaacggggcagtggagatggcggctgcagaggctgtgcatcacatacacctgcagaacttctcacgc

SEQ ID NO: 201063 - DNA, 2159 bp, Homo sapiens
  Payload ID: 19688
  Gene Name: zinc finger and BTB domain containing 45
  Uniprot ID: Q96K62
  ENST ID: ENST00000600990
  CDS Start-End: 136-1671
ggagtcggaggtggggtcgaatgggcatccccctgccgcagggcgggcgaggaggctggggcgtgccaggggaggggcacctgcgctccgctagaagcgcacgctgagaacgcgagggggcgctgcaggaccgggatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctcta

SEQ ID NO: 201064 - DNA, 5185 bp, Homo sapiens
  Payload ID: 19689
  Gene Name: zinc finger and BTB domain containing 46
  Uniprot ID: Q86UZ6
  ENST ID: ENST00000245663
  CDS Start-End: 152-1921
ggcgagcgcgcagctcggacccgcccggacgcagcgccctcccggcggcggcggcgatcaccggcgccggcccggcggccgcggcgcccgccctcgcccgcgccccatggggtcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccggtgggtctccactgcggggccagggccacgctcacccctctcgcggcccctcctctgcttccccctgaacccaccccccacggaaaccagccctgcgggctaagcaggtgcgaccccagcaagaggggtgctctgggaccagacatgaagtgagttgggggagggcacagggtgggtttgagtgaagggagagcacggtcctaagtccccagcaggtggtgcgggtgtgtgagtggcccctgtgatggccagcctggcttggacacgtgatgggcctgtggccgggtccagtgggcactgggcggggtggtgtgttcggcccagaggcccctggcctgagcaggtgcagagttttacagacacccggtcagcccggctggagcccgccctcccctcccctagcagccaggtcactgcctgtggctgcagccgtggcccgtggtgcagccgtggcccatggcagcctgtagaatccaggtgcacagagagccctgccaccgtcttacctctgggctttggtgcttaacacacaacacagctgcagaccctgctggaggccgagggctccaggtgctatcttaggtggacacagccctgggggctccttccaggaggggaccctcagccctgtgccccccaccacttcaggccacaccaggttccctctgcaagggcctcggctcagtcgtgtgcacttcctcggagagccttgggctgccacgtccaccccgggctctgcccgtcctgttctgcccatggcccagcccggccgctcctgctgacccctcctggacgggctggagctgggctcctgcctttgctgctaacactggaggcggtgttcctaactgcagtgtgctgcttacacctccccgcgtgggtaaccaaatttttaagtagtcagagacatatcgaggtagttacataaaattattttgtttggcattatttttctcactcgaagaaactatatagggttgtttttcctttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggcctcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccaggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagaggaaaaatgtgtagattacatttcacattttgtatttttgtttgtgtctgtttgtattttggtgtttacaacaccaaagtgggaaatacagtccattggggatggtgttatttgggggcggggagggggcagggacaccacgatttttctgtcaagctctggatcctgaccaggttgtacactggggctctctgagctttgggacacaggacactgccagggctacgtagggaactgactcagaagacgcagcttactgcttccaactttgcacatcttcctctttaaaaaactgagaaaatgcaaaaactggaactttttgcaatattataaaagaagtaatcttattttagctcattctgtgacatgtgcgactcttaagaaagccatacttaatggtggtggttttttttagatcttatattgtgttttgtatgcagcccttttagaactacttgtagtgagggtgctgtgtgtgcttttcttaaatatttatttttttcaacatgctttcaacctgtcaacaaaaacaaaacacacaaaaaaagggcagtgtttgaagattgttgatttttttctggggataatctatattatattgacttcctattacttattataaacctgtgtttgtattggagatgtgtctactattgggggaagaggttctcgtaatcgctcggtgggaaatcatggctctgccgtcctgcctctctgtggccgtgggttcacgtggcctctgcggtgagtctccaagtttctgcctaggcgcctgtgcgtttcctttctgtgacgggattagcttagacatccttgcaaagcgatcactttcaataaattgggaaattgctgctccagcag

SEQ ID NO: 201065 - DNA, 2335 bp, Homo sapiens
  Payload ID: 19689
  Gene Name: zinc finger and BTB domain containing 46
  Uniprot ID: Q86UZ6
  ENST ID: ENST00000302995
  CDS Start-End: 182-1951
gacggacggacggacggaccgagcagccccggcgagcgcgcagctcggacccgcccggacgcagcgccctcccggcggcggcggcgatcaccggcgccggcccggcggccgcggcgcccgccctcgcccgcgccccatggggtcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccgggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagagg

SEQ ID NO: 201066 - DNA, 5198 bp, Homo sapiens
  Payload ID: 19689
  Gene Name: zinc finger and BTB domain containing 46
  Uniprot ID: Q86UZ6
  ENST ID: ENST00000395104
  CDS Start-End: 167-1936
gatgggctctcgcgtgggtcgtcctcccactggccgcactctgtgccccatggccctcctgcgccccgcccggcgtcctctcacggcctctgtctgtgctgagcttgggtaactcttgttcttacctccacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccggtgggtctccactgcggggccagggccacgctcacccctctcgcggcccctcctctgcttccccctgaacccaccccccacggaaaccagccctgcgggctaagcaggtgcgaccccagcaagaggggtgctctgggaccagacatgaagtgagttgggggagggcacagggtgggtttgagtgaagggagagcacggtcctaagtccccagcaggtggtgcgggtgtgtgagtggcccctgtgatggccagcctggcttggacacgtgatgggcctgtggccgggtccagtgggcactgggcggggtggtgtgttcggcccagaggcccctggcctgagcaggtgcagagttttacagacacccggtcagcccggctggagcccgccctcccctcccctagcagccaggtcactgcctgtggctgcagccgtggcccgtggtgcagccgtggcccatggcagcctgtagaatccaggtgcacagagagccctgccaccgtcttacctctgggctttggtgcttaacacacaacacagctgcagaccctgctggaggccgagggctccaggtgctatcttaggtggacacagccctgggggctccttccaggaggggaccctcagccctgtgccccccaccacttcaggccacaccaggttccctctgcaagggcctcggctcagtcgtgtgcacttcctcggagagccttgggctgccacgtccaccccgggctctgcccgtcctgttctgcccatggcccagcccggccgctcctgctgacccctcctggacgggctggagctgggctcctgcctttgctgctaacactggaggcggtgttcctaactgcagtgtgctgcttacacctccccgcgtgggtaaccaaatttttaagtagtcagagacatatcgaggtagttacataaaattattttgtttggcattatttttctcactcgaagaaactatatagggttgtttttcctttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggcctcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccaggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagaggaaaaatgtgtagattacatttcacattttgtatttttgtttgtgtctgtttgtattttggtgtttacaacaccaaagtgggaaatacagtccattggggatggtgttatttgggggcggggagggggcagggacaccacgatttttctgtcaagctctggatcctgaccaggttgtacactggggctctctgagctttgggacacaggacactgccagggctacgtagggaactgactcagaagacgcagcttactgcttccaactttgcacatcttcctctttaaaaaactgagaaaatgcaaaaactggaactttttgcaatattataaaagaagtaatcttattttagctcattctgtgacatgtgcgactcttaagaaagccatacttaatggtggtggttttttttagatcttatattgtgttttgtatgcagcccttttagaactacttgtagtgagggtgctgtgtgtgcttttcttaaatatttatttttttcaacatgctttcaacctgtcaacaaaaacaaaacacacaaaaaaagggcagtgtttgaagattgttgatttttttctggggataatctatattatattgacttcctattacttattataaacctgtgtttgtattggagatgtgtctactattgggggaagaggttctcgtaatcgctcggtgggaaatcatggctctgccgtcctgcctctctgtggccgtgggttcacgtggcctctgcggtgagtctccaagtttctgcctaggcgcctgtgcgtttcctttctgtgacgggattagcttagacatccttgcaaagcgatcactttcaataaattgggaaattgctgctccagc

SEQ ID NO: 201067 - DNA, 3781 bp, Homo sapiens
  Payload ID: 19690
  Gene Name: zinc finger and BTB domain containing 47
  Uniprot ID: Q9UFB7
  ENST ID: ENST00000232974
  CDS Start-End: 282-2525
gagcaagggggccactcagcagtggtcaggtcacacggctagaggggcacagtggggcctgggcctctggtccctactcctctggtccctctgtctcctggccctgggccagtcaccttagatgatttgatcgctgcggttgtagtcctgggatttaaatctcctgccctgggtggccctatgcagcatgaggccgccagttgctggttgagaagacaactgactccccggcggctgagttctcgctggtggaggacgtggcgctgcactttgcctgcttgatgggccgcctgaacgagcagcgcctcttccagcctgacctctgcgacgtggacttggtgctggtgccccagcgcagcgtctttccggcacacaagggtgtgctagccgcctacagccagttcttccactcactcttcacccagaacaagcagctgcagcgtgtggagctgtccctggaggcactggcacctggtggcctgcagcagatcctcaacttcatctatacgtccaagctgctggtcaacgcggccaacgtccacgaggtgctcagcgccgcctcattgctgcagatggctgacatcgctgcgtcctgccaagagctgctggacgcccgctctctaggcccaccaggtccgggcactgtggccctggcccagccggctgccagctgcactccagctgcgccgccctactactgtgacatcaagcaggaggccgacaccccaggcctgcccaagatctatgcccgcgagggccctgacccttactcggtgcgtgttgaggacggggcagggactgctggtggcacagtgcctgccaccattgggccagcccagcccttctttaaggaggagaaggagggtggtgtcgaggaggccggtgggcccccagccagcttgtgcaagctggagggtggagaagagttggaggaagagcttgggggttctggcacctacagccgcagggagcaatcccagatcatcgtggaggtgaacctcaacaaccagacactgcacgtgtccacggggccagaggggaagccaggtgccgggccaagcccagccaccgtggttctgggccgggaggacgggctgcagagacactcggacgaggaggaggaggacgacgaggaggaggaggaggaagaagaggaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtca

SEQ ID NO: 201068 - DNA, 2456 bp, Homo sapiens
  Payload ID: 19690
  Gene Name: zinc finger and BTB domain containing 47
  ENST ID: ENST00000505904
  CDS Start-End: 319-1200
gatctatgcccgcgagggccctgacccttactcgccgcagggagcaatcccagatcatcgtggaggtgaacctcaacaaccagacactgcacgtgtccacggggccagaggggaagccaggtgccgggccaagcccagccaccgtggttctgggccgggaggacgggctgcagagacactcggacgaggaggaggaggacgacgaggaggaggaggaggaagaagaggaagaggaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtca

SEQ ID NO: 201069 - DNA, 1050 bp, Homo sapiens
  Payload ID: 19691
  Gene Name: zinc finger and BTB domain containing 48
  ENST ID: ENST00000319084
  CDS Start-End: 119-1050
gacgtcacgtccggcgcggagacggtggagtctccgcactgtcggcggggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacag

SEQ ID NO: 201070 - DNA, 2293 bp, Homo sapiens
  Payload ID: 19691
  Gene Name: zinc finger and BTB domain containing 48
  Uniprot ID: P10074
  ENST ID: ENST00000377674
  CDS Start-End: 159-2225
gggtacgcatagccgggcactaggttcgtgggctgtggaggcgacggagcagggggccagtggggccagctcagggaggacctgcctgggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 201071 - DNA, 1001 bp, Homo sapiens
  Payload ID: 19691
  Gene Name: zinc finger and BTB domain containing 48
  ENST ID: ENST00000435905
  CDS Start-End: 124-1001
cggagacggtggagtctccgcactgtcggcggggtacgcatagccgggcactaggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatg

SEQ ID NO: 201072 - DNA, 784 bp, Homo sapiens
  Payload ID: 19691
  Gene Name: zinc finger and BTB domain containing 48
  ENST ID: ENST00000488936
  CDS Start-End: 95-784
gcgacggagcagggggccagtggggccagctcagggaggacctgcctggtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacc

SEQ ID NO: 201073 - DNA, 790 bp, Homo sapiens
  Payload ID: 19691
  Gene Name: zinc finger and BTB domain containing 48
  ENST ID: ENST00000466813
  CDS Start-End: 1-387
atgatcaaacttcatggagcccccaagccccatgcaagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcct

SEQ ID NO: 201074 - DNA, 2449 bp, Homo sapiens
  Payload ID: 19691
  Gene Name: zinc finger and BTB domain containing 48
  ENST ID: ENST00000619514
  CDS Start-End: 531-926
tgagggcggaagggacaggcataggagggactctgtgggaggcatttggggttggctttcctaggcccctggcccacctccaccttggctttggagaaggggagccgctacaggggatggcagctgggaaaggccccctggccacccccagcaaccccactgctggcttctgtgtcagggcccgccgaaacccaggcccactcttcctagaggcctgtcagcagccactagggccagggactgtgggtgaggccactcggaccctgcccccagtctgtctgggcctgagaagggcctggtgtgcggtgggcttgcagcactcagtgatggtcaggccaggcaggttatgtgttgccctctcccaccctagcgtccccaccctccccaggcagactcttcccagcagcaagcggaagcccgggcagaggctgctgtcataggcagaggcccccgctgatgccggccctgcttgcccctcacactgccaggtcttcacgtgctctgtgtgccaggagacattccgccgaaggatggagctgcgggtgcacatggtgtctcacacaggggagatgccctacaaggtcaggcttggcctgtctccagggccagggttgggtggccccaggatccttcctgctgagccctttacgtggggtgctgtcaggcacctccctcacagtagctgtcagggagcctgccttccctgccttccctgcctttccagtgcccccttatctaggcagggcctgtctgcagcctcacctccaaggtccttattaggcccttgtttctttccatggaggacaggcttggcatcctctgggcagctgagccctgaggccctcctttgcaccatccttcacaccagatcaggggtcctcccagaatcatctcaccggggcctccctctagttcctgccctatagcccaagggtgggtggcagggtttcatgggtgcaggccgccctggaggtgactgtgggcctctttttcagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaaggtgaggtacgccctgcccctcccctcgcctccccatcctgaggccaaggccacaggctgagctcttgccttgtgcctgcagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaaggtacctgggcggccctgggagagccatttcctgctcatccgagttggagggtctctgaggaggaaacgctcctttcttgcctgtgaacctcttttgtgccccacatggttagagttgagagtggacctgctttgaaggcaggggtgtcctgtgcagtagtgaccctgggtggcactggagagcctggcagggcctgtgcagcacttgtaaaccactggtcccctcccttgctgcctgtcccaacctcctgctgggtttcctcgagggtcccggggctcctgcatgatcccccacggtgttctccctcttgcagccgtggagcaactgcgtgtgcacgtcagacggcacaagggggtgaggaagtttgagtgcaccgagtgtggctacaagtttacccgacaggtaggccagggcctgggccccttcccctaccctaggatcccccaaagttctgagctcaccctccccgccaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttgg

SEQ ID NO: 201075 - DNA, 2889 bp, Homo sapiens
  Payload ID: 19692
  Gene Name: zinc finger and BTB domain containing 49
  Uniprot ID: Q6ZSB9
  ENST ID: ENST00000337872
  CDS Start-End: 122-2419
gttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggtgagaaaccttttgaatgtaacatttgtgggaaacatttctctcaggcaggtaacttgcagactcacttacgacggcattctggtgaaaaaccatacatctgcgagatctgtggaaagaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatatta

SEQ ID NO: 201076 - DNA, 523 bp, Homo sapiens
  Payload ID: 19692
  Gene Name: zinc finger and BTB domain containing 49
  ENST ID: ENST00000504302
  CDS Start-End: 1-523
gcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacagggaaatgttttgggggatcaggtgacctccgcaggcatgtccgcactcacactgggga

SEQ ID NO: 201077 - DNA, 2380 bp, Homo sapiens
  Payload ID: 19692
  Gene Name: zinc finger and BTB domain containing 49
  ENST ID: ENST00000515012
  CDS Start-End: 122-1483
gttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttcccca

SEQ ID NO: 201078 - DNA, 2520 bp, Homo sapiens
  Payload ID: 19692
  Gene Name: zinc finger and BTB domain containing 49
  ENST ID: ENST00000503703
  CDS Start-End: 122-556
gttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggcaggtaacttgcagactcacttacgacggcattctggtgaaaaaccatacatctgcgagatctgtggaaagaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatatta

SEQ ID NO: 201079 - DNA, 502 bp, Homo sapiens
  Payload ID: 19692
  Gene Name: zinc finger and BTB domain containing 49
  ENST ID: ENST00000502918
  CDS Start-End: 65-502
cggccagcggatcgctgcgagtggccttgaaggcagctgctgcaggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgt

SEQ ID NO: 201080 - DNA, 492 bp, Homo sapiens
  Payload ID: 19692
  Gene Name: zinc finger and BTB domain containing 49
  ENST ID: ENST00000511458
  CDS Start-End: 1-368
agcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggcaggtaacttgcagactcacttacgacggcattctggtgaaaaaccatacatctgcgagatctgtggaaagagggaaatgttttgggggatcaggtgacctccgcaggcatgtccgcactcacactgggga

SEQ ID NO: 201081 - DNA, 4627 bp, Homo sapiens
  Payload ID: 19693
  Gene Name: zinc finger and BTB domain containing 5
  Uniprot ID: O15062
  ENST ID: ENST00000307750
  CDS Start-End: 190-2223
gcgaactggctggaggagctaggggactagaggcggggtgggaggggggcgggtggaagggggaggaagtcccgtaacggagacgctggtcaggacgttcccacctcctctgacactgccgagtccgatcggagaggggtcaccgcctccttcagcgaggaggaggggggcggagcccgactcaggatcatggattttcctggtcactttgaacaaatcttccagcagctgaactaccagagacttcatggccagctctgtgattgtgtcattgtagtggggaatagacactttaaagcccaccgctccgtgctggcagcatgcagcacgcatttccgagccctgttctcagtggcagaaggagatcagaccatgaacatgatccagctggatagcgaggtggtgacagcagaggcctttgctgcactgattgacatgatgtatacctccaccctcatgctgggggagagcaatgtaatggatgtcttattggcagcctctcacctgcatttgaactctgttgttaaggcatgtaaacattacttaacgacaaggacgctgcccatgtctccccccagtgagcgcgttcaggagcagagcgcccgcatgcagcgctcctttatgctacagcagctgggactaagcatcgtgagctcagccctcaattccagccagaatggcgaggagcagccagcccccatgagctcttccatgcgcagtaacctggatcagcgcacgcccttccccatgagacgccttcataagcgcaagcagtctgcagaggagcgggccaggcagcgcctccgaccctccatagatgagtctgccatttcagatgttacaccggagaatgggccttcaggggttcattctcgggaggagttcttttcaccagattctctgaaaattgtggataatcctaaagctgatggaatgactgataaccaggaagatagtgcgatcatgtttgatcagtcttttggcactcaagaagatgcccaggtgcccagccagtctgataacagtgctggcaacatggcacagttgtccatggcctctcgtgcaactcaggttgagactagttttgatcaggaagctgcacctgagaaaagtagttttcagtgtgaaaaccctgaggttggccttggtgagaaggagcacatgagagtggtggttaaatctgagcccctgagctcacctgagcctcaggatgaagtgagcgatgtgacctcacaagcagaaggcagcgagtctgtggaagtggaaggagttgtggtcagtgccgagaagatagacctcagccctgaaagcagtgatcggagtttttcagatccccagtctagcacagacagggtaggtgatatccatattttggaagtcacaaataacctagagcataagtccacttttagtatttcgaattttcttaacaagagcagaggaaataactttactgcaaatcagaacaatgatgataatattccaaacaccactagtgactgcaggctggagagtgaggccccctatttgttgagtccagaggctgggcctgcaggtgggccctcctctgcccctggctcccatgtagagaacccatttagtgaacctgcagactcccacttcgtcaggcctatgcaggaggtgatgggcctgccgtgtgtgcagacttcaggctaccaaggaggagaacagtttgggatggacttttccaggtctggtttgggcctccactcctccttctccagggtaatgataggttccccaaggggaggagccagtaactttccttactaccgccgcatagctcccaaaatgccagttgtaacttccgtcaggagctcacagatcccagaaaactctaccagttctcagctaatgatgaatggagctacgtcctcatttgaaaatggccatccttcccagcctggccctccacagttgaccagggcatctgcagatgttctgtcaaagtgcaagaaggccttatcagagcacaatgttttggttgtagagggagctcgcaagtatgcctgcaaaatctgctgcaaaacttttctgactttgacagattgcaagaagcacatccgtgttcacacaggtgaaaagccttacgcctgcctgaagtgtggcaagaggtttagtcagtccagccacctgtataagcactcaaagactacctgcctgcgctggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggccctacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcatatt

SEQ ID NO: 201082 - DNA, 4106 bp, Homo sapiens
  Payload ID: 19694
  Gene Name: zinc finger and BTB domain containing 6
  Uniprot ID: Q15916
  ENST ID: ENST00000373659
  CDS Start-End: 90-1364
gtgttttcttccaggctaagtccatcttccggcttgggcagacgctgccgcggaatccttgactctagttttctgagtcgattgtgatcatggctgctgagtctgatgttctgcatttccagtttgaacagcaaggagatgtggtcttgcagaaaatgaatcttttgagacagcagaatttattttgtgatgtatcaatttacattaatgacactgagttccaggggcacaaggtgattttggctgcttgctccacttttatgagagatcagtttttactcacacagtcaaaacatgtcagaatcaccatcttacagagtgcagaagttggcagaaaattgttactgtcttgctatactggagcacttgaagttaaaaggaaagagcttttgaaatacttgactgctgccagttaccttcagatggttcacattgtggaaaagtgcacagaagctttgtcaaagtatctggaaattgatctttctatgaaaaacaacaaccaacacactgacctgtgtcagtcttctgatcctgatgttaagaatgaagatgaaaattctgataaagactgtgagataattgaaatttcagaagatagtcctgtaaacatagatttccatgttaaagaagaggaaagcaatgctttgcagtctacagtagagagtctgacatcagagagaaaggaaatgaagtcaccagagctgtctacagtagacataggttttaaagacaatgaaatttgtatccttcatgtagaatccatcagtacagctggtgtcgaaaatgggcagttttcacagccttgtacctcttcaaaagcaagcatgtatttctctgaaacacagcattcattgatcaattctacagttgagagcagagtggctgaagttcctgggaatcaagatcagggcttattttgtgagaatactgaaggaagttatggtacagtgagtgagattcagaatctggaggaaggttattcactgaggcaccagtgccccaggtgtcctcgaggctttcttcatgttgaaaactatctgcgccaccttaaaatgcataaactattcttatgcttacagtgcggaaaaacatttacacagaagaaaaatctcaaccgacacatccgaggacacatgggcatacggccctttcagtgtactgtgtgcttgaagacatttactgccaaaagcacacttcaggaccacttgaacatacacagtggggatcggccatacaaatgccactgttgtgatatggatttcaagcacaagtctgctctcaaaaagcacttaacctctgtccatggcagaagcagtggtgaaaaactatctaggcctgatctcaaaaggcaaagtctactataattataatcacagacttgttatataaagtttgtattattctattacgcaagtctttctgtagagatgcagcatttgtaatatttcatccccccaatctttgtttcttatattttgtcggcttacacataatcattctttctgaacttctaacagttccaaagttatgggaggcacagtaaagctgatgggattctgtctcatctcataccttacatataagtctcagtagtatccctagagaaatagtgttcctctcttatatattcttgattctagtgacaaaggatccagcagtatttgcagattccgatttggagtctctaggtaattgatttaagtataaaatccaatcatataaaaactttaatgaattaggataacaagaagagaaaataaaggtaaaaacactattacctgtttctagtcactttagaacagatggcactaaaaaaatttttttttaactttttaccagctgttcttggattccaaactaaacaccaagatacttttcattttaaaatgtataaagtaacaattcagattcacttgggaatagcagaatttttttatacagggttaataatccttaaaatacttttatttccatgccttattagtatacatacttaagaaatggttcattgggcccgagtttcttgattttatttaatacaatcggatttaataattttgtggccagtaaaattataccattggcatgaagctgtgaaaaatgagaaattctacctttaccagggatatctgttctactgttttaaaagttcctctctattttattttttatttaacatgaagtaaaattgaaatttcttcttggtgtatagttctgtgaattttaacagaaagatttgtgcaccactactgcagtcggtacagaacagttccttcactcccaatagctctcttatgctgtccctttgtagtcagctccttctagctctaatcctggcaacagttctccgtcactattattttgccttttctggactgtcatataaacagaatcttatagtacgttccctcttgaaatgctttttcacccagcataatgactttgaggttcatccatgtcattttaaattttgaattggcaatatatattctagctgttactagatgagcaatttaaaaaggtgtagctattagtgttgtattttttcatttacattaatgtaatttccattcactatgtgttgataaaaatcttaaccatccctagagttttatatttccaaaaatatgccaaaaggaaaactatgactgtatgattattttagcgagagtcatatttgagatggtgttctgagccatagttctctaacatctccgtctacatataacacaaaacttttataaattattttaacaaagattaaaatatactgcagggcaaataatattctctaaaacacaggaactgcttttcgtaaagaagactgactagatgcatctttctttgaagctgttctagtcctcctctagttaacttagctttatgtagaatttctactgtatttaatttctattgaagcccttctgtattttaaaatgtaatatactttgtaccatttataaaaattgtgtgatgaatgaatcacatgttcgttgttataagtgttaacctttttttgacaattttgtgggaaagacattctccactgaattttaactttccttgagactttcaagaatgcaggtctcgtttgatgaaaaaaccgacttcataacccaatgttactagttagcgacattgtgctgaatttctccttgaactttttaactttatatgtaaaataactttgatcttggtcatttgaaagatcatttccaggtctaaaattccatgattttgtatttaattcttcctgagaacagaagaggggaaagcaagagaggacggttttgtgtctttatgaactttgttacttaagtactccattggagacataatttttctaattagtggatctttttccactggaaagtgtgatagctcattgctaatttttcattcatagttcattgcttccatttgacctaagattggccatttgttggtgtgaaaatattttcttttcagaaatagtttactagtgattgaagtacttttcttatttttgcttcctattataaaatggcgtggggggaagggggaaggatggagatgggaggagagggtaaaagaatagtactctgattttttaagaattagtatctactatcttggatatttgaaaaaaaattggttgaaactatgtttaagttttatgtgtgccttgtaagattgttgtaaaattttttgtgagcactttgagatttttgctgggggaggggtgttttgtgaaagtgatggttattatttatattatttattcctgttcagtagcacggaatgatctccaaacattcctaggagagtgtctgtttgcatgatatgtctaaaaattttcaggaaaatggaatctttttttaaagttcaggtatgacaaagtatagaatttattcatttaacatattcacatttagtttatgtttctgatatgacagaaaaatgaaaagtgtttgagttcagcctcttcatttactccatttacatataaaagatcttgaaaaggtagttgttacttcgttgtcagagaaaaacacttgccctttttcctgggatgtaactatcttacatgtttacataagaaataataaactggaggtgggaatgga

SEQ ID NO: 201083 - DNA, 5422 bp, Homo sapiens
  Payload ID: 19695
  Gene Name: zinc finger and BTB domain containing 7A
  Uniprot ID: O95365
  ENST ID: ENST00000322357
  CDS Start-End: 280-2034
ggcggctgcggcacctttaagacaagggaggacccctcttgccctcggagaaaccaggaagggagtcgcgagcatcatacggggctttggctgtactgtacagttactgtaggggcagtgacgccgccgccgccgcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtccccttttttggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctacaggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgccccccgacgccccccgccttttgagattaaggaaaaaaaaaaaaagtcaaaaaagtttttaaaaa

SEQ ID NO: 201084 - DNA, 2083 bp, Homo sapiens
  Payload ID: 19695
  Gene Name: zinc finger and BTB domain containing 7A
  Uniprot ID: O95365
  ENST ID: ENST00000601588
  CDS Start-End: 319-2073
tccccgcgctccccggggagggcggcggcccgggcggccgcgcggtgcaggcgagcccggggatgcgcggcctagcgcaggccgggcccgggcgtgggggaggcgggcgggcggacccagatccggggtaatttgcatcgccctccccccagcccgggtggggattggccgccggcggcggggggtggcgcggggccaggctcactgccgcctcccggcccctcggagggagccagcccagccgcagccgccgccaccgccgccgccggggccgggccccctcgccgctgccccgggaaggaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaa

SEQ ID NO: 201085 - DNA, 2129 bp, Homo sapiens
  Payload ID: 19696
  Gene Name: zinc finger and BTB domain containing 7B
  Uniprot ID: O15156
  ENST ID: ENST00000292176
  CDS Start-End: 214-1833
tcacctgtctgaacctcagtttccttgtctgtgaaacagatgatgatcatacttcagagggttctggaagatgaaatgagtgtaaagtactcagaagggtgactggcatgcagtcatccctcaataagtattggctaaagttggtcctctttccccagacccctgtgggctgagcgctcttaatctcccctctacttgactctgcaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataa

SEQ ID NO: 201086 - DNA, 3594 bp, Homo sapiens
  Payload ID: 19696
  Gene Name: zinc finger and BTB domain containing 7B
  Uniprot ID: O15156
  ENST ID: ENST00000368426
  CDS Start-End: 138-1757
agctggaggacaggtgagacagcaggacaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctccctttcgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggacctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattc

SEQ ID NO: 201087 - DNA, 4017 bp, Homo sapiens
  Payload ID: 19696
  Gene Name: zinc finger and BTB domain containing 7B
  Uniprot ID: O15156
  ENST ID: ENST00000417934
  CDS Start-End: 459-2180
agggaggggagggatggggggaaagcaagctggaggacaggtgagacagcaggacaggtgaggcgggccctgaggggggggcgggtgggagccaggtgaatgtacggctcttggcggccgagggggggcgggcggcaggaggaggcagagggcggcggaggaggagccccccagcagcgagcggcgagcaactgaccgcggccttctgaccaggaccggagcagggccccaagcccccgggcctggtgggggacgcgcttcttcccacactgtgagcctcagcagctccagccagcggacccgacggctgagaggagccccagaaccaggactgggggatttggagctgggcagagacttaacccccacagcaccgggaagcagccaactcccctcgcctccttcccccttcgtggcttgcggtctctcttccccgcctcggcccccaggaagtgaagatgttacagcctggtcctcatcctccctcaccccaagctgctgctcctggagaagcctggccaggcccctctcaggctccctggcagagcctagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctccctttcgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggacctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattc

SEQ ID NO: 201088 - DNA, 3777 bp, Homo sapiens
  Payload ID: 19696
  Gene Name: zinc finger and BTB domain containing 7B
  Uniprot ID: O15156
  ENST ID: ENST00000535420
  CDS Start-End: 321-1940
agggaggggagggatggggggaaagcaagctggaggacaggtgagacagcaggacaggtgaggcgggccctgaggggggggcgggtgggagccaggtgaatgtacggctcttggcggccgagggggggcgggcggcaggaggaggcagagggcggcggaggaggagccccccagcagcgagcggcgagcaactgaccgcggccttctgaccaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctccctttcgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggacctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattc

SEQ ID NO: 201089 - DNA, 4818 bp, Homo sapiens
  Payload ID: 19697
  Gene Name: zinc finger and BTB domain containing 7C
  Uniprot ID: A1YPR0
  ENST ID: ENST00000535628
  CDS Start-End: 372-2231
gctcctccaccgcccttgcctttatttctgctttaccttttccaaagatcttaatttggtgtcataaagtgaagcgtaacgcgcgagtggtgagatcgtcctgtcctgcgcttaacagtacaggtggaccaaaggggctcccggccaaatacttctggttggagggtggggagggagtgctctctcaaaaccactcctggaatggcttaactcgcccagcacgaatcaatgacaacctcccgccggctgcggcaggctcccgcgagcagcgcggccgcgtggattcccagcccgggaccctggcggcgctcaggacacggcccgggcacgagcgcggcgtccccggggcggccagggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtggggggaggggtggttgtgtttttgttttgcttcaatttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaagaaaaaaaaaaaaacctttgacccttattttatactttaaaggacagtgttttgagtaaaagtgagctatgcttgctta

SEQ ID NO: 201090 - DNA, 600 bp, Homo sapiens
  Payload ID: 19697
  Gene Name: zinc finger and BTB domain containing 7C
  ENST ID: ENST00000585404
  CDS Start-End: 526-600
ctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgcctgtttctttgacagcccagacttagagcaatgtgtccctcctttgagctcctgaagggccagctgaagactctgtcatttggttggtggaggccaagagaaagggtctcgttctgttgcccaggtgagcctggagtgcagtagtacagtcacagctcactgcagcctcaaactcttgggctcaagagatgttcctgcctcagcctcccaagtagtcgggactacagggctctggctgagaacatggccaatgacattgatgagctcattggcattcccttccccaaccacagcagtgaggtcctgtgcagcctcaat

SEQ ID NO: 201091 - DNA, 574 bp, Homo sapiens
  Payload ID: 19697
  Gene Name: zinc finger and BTB domain containing 7C
  ENST ID: ENST00000590178
  CDS Start-End: 519-574
tcctacctgcaattgctgtgtgtgtgtgtatgtgtacacacacagaacatgaagaactacatccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaaccacagcagtga

SEQ ID NO: 201092 - DNA, 518 bp, Homo sapiens
  Payload ID: 19697
  Gene Name: zinc finger and BTB domain containing 7C
  ENST ID: ENST00000591279
  CDS Start-End: 444-518
aggaggacgccaggactgcgtcccggagccaagtgcgggaggcgcgcagggccggcggcgcgcggagtctcacttcgcgctgtcttttcttgaaaattggaaaatgagctggaaaggctgggatccagcacctctcgatgagatctgagcagagtacagtccttgcccgaggtgtcgctcatgcaggactcaaagatccttgctgctgtcaagtcgggaagctgggggaaatgggcgcacgcacacagttcctccaagcctcggacaagtgaagccgagcctggcccggtgcctgtcgccgcgcggggtagtgcgaggtctgttcccagcgacacgcacgggaactgcgtgcgtcttctctcaaggaaatgagcagatttgcagaaaaactggtgtcctgaaatttaaaactaaggcatcggtgcttggctctggctgagaacatggccaatgacattgatgagctcattggcattcccttccccaaccacagcagtgaggtcctgtgcagcctcaat

SEQ ID NO: 201093 - DNA, 630 bp, Homo sapiens
  Payload ID: 19697
  Gene Name: zinc finger and BTB domain containing 7C
  ENST ID: ENST00000590374
  CDS Start-End: 586-630
tccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgtgccaggcagcacctggaagctctgggaaatccacgagaagcagcaggcattggctctgttttggaggagctttcagtccagttcaggaagagaagacacctgcatatgagacaaagaactttatgaccagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaac

SEQ ID NO: 201094 - DNA, 704 bp, Homo sapiens
  Payload ID: 19697
  Gene Name: zinc finger and BTB domain containing 7C
  ENST ID: ENST00000587107
  CDS Start-End: 630-704
aggaggacgccaggactgcgtcccggagccaagtgcgggaggcgcgcagggccggcggcgcgcggagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgtgccaggcagcacctggaagctctgggaaatccacgagaagcagcaggcattggctctgttttggaggagctttcagtccagttcaggaagagaagacacctgcatatgagacaaagaactttatgaccagacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaaccacagcagtgaggtcctgtgcagcctcaat

SEQ ID NO: 201095 - DNA, 566 bp, Homo sapiens
  Payload ID: 19697
  Gene Name: zinc finger and BTB domain containing 7C
  ENST ID: ENST00000593159
  CDS Start-End: 522-566
tccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttagctgctctaagctgtgggccaacaggaggctgggagctctcctctaaattgctttgtgaccttggacaagaaccctccccttcctggactgcaaatttcctcctctgtaaaatgaagggttgggaacttaggtgctgtcttggccaagttcagaaacatgtaggacattatggagaagtgttaaagccagggctctggctgagaacatggccaatgacattgatgagctcattggcattcccttccccaac

SEQ ID NO: 201096 - DNA, 397 bp, Homo sapiens
  Payload ID: 19697
  Gene Name: zinc finger and BTB domain containing 7C
  ENST ID: ENST00000592387
  CDS Start-End: 323-397
aggaggacgccaggactgcgtcccggagccaagtgcgggaggcgcgcagggccggcggcgcgcggaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgatgcaacaactgaggcatagagaagtcacttgcccaaggtcacccagcagggctctggctgagaacatggccaatgacattgatgagctcattggcattcccttccccaaccacagcagtgaggtcctgtgcagcctcaat

SEQ ID NO: 201097 - DNA, 566 bp, Homo sapiens
  Payload ID: 19697
  Gene Name: zinc finger and BTB domain containing 7C
  ENST ID: ENST00000586743
  CDS Start-End: 492-566
ctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgggaacttaggtgctgtcttggccaagttcagaaacatgtaggacattatggagaagtgttaaagccagggctctggctgagaacatggccaatgacattgatgagctcattggcattcccttccccaaccacagcagtgaggtcctgtgcagcctcaat

SEQ ID NO: 201098 - DNA, 585 bp, Homo sapiens
  Payload ID: 19697
  Gene Name: zinc finger and BTB domain containing 7C
  ENST ID: ENST00000588053
  CDS Start-End: 530-585
acacagaacatgaagaactacatccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgatgcaacaactgaggcatagagaagtcacttgcccaaggtcacccagcagggctctggctgagaacatggccaatgacattgatgagctcattggcattcccttccccaaccacagcagtga

SEQ ID NO: 201099 - DNA, 321 bp, Homo sapiens
  Payload ID: 19697
  Gene Name: zinc finger and BTB domain containing 7C
  ENST ID: ENST00000586047
  CDS Start-End: 266-321
cacacagaaatgaagcaacctgaaggcagctccatggggccgctgtccctgttgttgatgtttctggaatatgggtctaggatcagaagcaaaagaggaagtccattcttttgcactgcagaacattcctacagtggacccaagctgttttgtccttctcagcagctttaagatttctccacatagggaaatgagcagatttgcagaaaaactggtgtcctgaaatttaaaactaaggcatcggtgcttggctctggctgagaacatggccaatgacattgatgagctcattggcattcccttccccaaccacagcagtga

SEQ ID NO: 201100 - DNA, 462 bp, Homo sapiens
  Payload ID: 19697
  Gene Name: zinc finger and BTB domain containing 7C
  ENST ID: ENST00000589077
  CDS Start-End: 388-462
ctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgcatggcataggtgacatgaaagcttctgtctccagacccttgtcttcaagaggagtgctggcctgtcaatgagcgtgcctgattaccgtgggctctggctgagaacatggccaatgacattgatgagctcattggcattcccttccccaaccacagcagtgaggtcctgtgcagcctcaat

SEQ ID NO: 201101 - DNA, 546 bp, Homo sapiens
  Payload ID: 19697
  Gene Name: zinc finger and BTB domain containing 7C
  ENST ID: ENST00000590437
  CDS Start-End: 347-546
gacgggctacgtcggagtgttgtcttagattcgaatgcatgaggaactggaataatcagtaacatttctcccagacagagctgctctaagctgtgggccaacaggaggctgggagctctcctctaaattgctttgtgaccttggacaagaaccctccccttcctggactgcaaatttcctcctctgtaaaatgaagggttgagaaagggtctcgttctgttgcccaggtgagcctggagtgcagtagtacagtcacagctcactgcagcctcaaactcttgggctcaagagatgttcctgcctcagcctcccaagtagtcgggactacagggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcac

SEQ ID NO: 201102 - DNA, 891 bp, Homo sapiens
  Payload ID: 19697
  Gene Name: zinc finger and BTB domain containing 7C
  ENST ID: ENST00000589170
  CDS Start-End: 847-891
tccagaagctgcccagaaaggatgcagcaccccctgcaacctgcaatttggcaccttggaatcttttaataaataaccaaggagacaagaaatggcctctccaaaatgtccacactcaaatccccagaacctctcctctgatggtctgttagccccgctctggggaaaccagccattgagacagaaggaagcagcgcccagtgacactctgcttacccagagaccagcctgcaagcaacctctcctatccagaacacagacacagatggcaaagtcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacagtgctatgaagaaatggaaggtcaggaaggtggataaactttcccaaaaccacacagctaaaaacatgtttcaacccctgggttgagtccaaagccagtagtgctttgtaacgcagtctcccagttcttctggctaatagaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaac

SEQ ID NO: 201103 - DNA, 467 bp, Homo sapiens
  Payload ID: 19697
  Gene Name: zinc finger and BTB domain containing 7C
  ENST ID: ENST00000588566
  CDS Start-End: 423-467
tccagaagctgcccagaaaggatgcagaagaggtggccttctccagaaagattttaaagtgggctctatttgtgtgttcgtaaacatcctctgatggcttctaggaactggacactgagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttggctctggctgagaacatggccaatgacattgatgagctcattggcattcccttccccaac

SEQ ID NO: 201104 - DNA, 430 bp, Homo sapiens
  Payload ID: 19697
  Gene Name: zinc finger and BTB domain containing 7C
  ENST ID: ENST00000591405
  CDS Start-End: 375-430
gtgtgtgtgtgtatgtgtacacacacagaacatgaagaactacatccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttggctctggctgagaacatggccaatgacattgatgagctcattggcattcccttccccaaccacagcagtga

SEQ ID NO: 201105 - DNA, 4947 bp, Homo sapiens
  Payload ID: 19697
  Gene Name: zinc finger and BTB domain containing 7C
  Uniprot ID: A1YPR0
  ENST ID: ENST00000590800
  CDS Start-End: 501-2360
gaggagctgcccgctcgcccgctgccgccgctcagctccatacccgccggcgcagccccgccacgagactctgacagcggcgcggccggcgaggctcgggcgcgcagggaccggcggacaccggcggcgaaggaggacgccaggactgcgtcccggagccaagtgcgggaggcgcgcagggccggcggcgcgcggagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtggggggaggggtggttgtgtttttgttttgcttcaatttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaagaaaaaaaaaaaaacctttgacccttattttatactttaaaggacagtgttttgagtaaaagtgagctatgcttgctta

SEQ ID NO: 201106 - DNA, 725 bp, Homo sapiens
  Payload ID: 19697
  Gene Name: zinc finger and BTB domain containing 7C
  ENST ID: ENST00000589194
  CDS Start-End: 651-725
aggaggacgccaggactgcgtcccggagccaagtgcgggaggcgcgcagggccggcggcgcgcggagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgtgccaggcagcacctggaagctctgggaaatccacgagaagcagcaggcattggctctgttttggaggagctttcagtccagttcaggaagagaagacacctgcatatgagacaaagaactttatgaccaggcatggcataggtgacatgaaagcttctgtctccagacccttgtcttcaagaggagtgctggcctgtcaatgagcgtgcctgattaccgtggtaatcaccagcgaatggtgtgattttataatacatttccatctgaaatatgaacagggctctggctgagaacatggccaatgacattgatgagctcattggcattcccttccccaaccacagcagtgaggtcctgtgcagcctcaat

SEQ ID NO: 201107 - DNA, 680 bp, Homo sapiens
  Payload ID: 19697
  Gene Name: zinc finger and BTB domain containing 7C
  ENST ID: ENST00000592656
  CDS Start-End: 606-680
ctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgtgccaggcagcacctggaagctctgggaaatccacgagaagcagcaggcattggctctgttttggaggagctttcagtccagttcaggaagagaagacacctgcatatgagacaaagaactttatgaccagacagagctgctctaagctgtgggccaacaggaggctgggagctctcctctaaattgctttgtgaccttggacaagaaccctccccttcctggactgcaaatttcctcctctgtaaaatgaagggttgatgcaacaactgaggcatagagaagtcacttgcccaaggtcacccagcagggctctggctgagaacatggccaatgacattgatgagctcattggcattcccttccccaaccacagcagtgaggtcctgtgcagcctcaat

SEQ ID NO: 201108 - DNA, 565 bp, Homo sapiens
  Payload ID: 19697
  Gene Name: zinc finger and BTB domain containing 7C
  ENST ID: ENST00000588028
  CDS Start-End: 521-565
tccagaagctgcccagaaaggatgcagcaccccctgcaacctgcaatttggcaccttggaatcttttaataaataaccaaggagacaaatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttagaaagggtctcgttctgttgcccaggtgagcctggagtgcagtagtacagtcacagctcactgcagcctcaaactcttgggctcaagagatgttcctgcctcagcctcccaagtagtcgggactacagggctctggctgagaacatggccaatgacattgatgagctcattggcattcccttccccaac

SEQ ID NO: 201109 - DNA, 4899 bp, Homo sapiens
  Payload ID: 19697
  Gene Name: zinc finger and BTB domain containing 7C
  Uniprot ID: A1YPR0
  ENST ID: ENST00000586438
  CDS Start-End: 453-2312
gcacaacaggaacagagggaaaggctttgtcttcaaaggtgtcccagcagttacaacaaggactagagcaggtgctgatgaggccgcagtttgggagtctgatccctaacaaggccaggtcccctctctctgcccaagtttgctctctgaatacagaggaggacttgggccatagagtatgggcagctccgcagggcgattcttgctcatcactggacactcattgtctctgaaggacgggctacgtcggagtgttgtcttagattcgaatgcatgaggaactggaataatcagtaacatttctcccagacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtggggggaggggtggttgtgtttttgttttgcttcaatttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaagaaaaaaaaaaaaacctttgacccttattttatactttaaaggacagtgttttgagtaaaagtgagctatgcttgctta

SEQ ID NO: 201110 - DNA, 572 bp, Homo sapiens
  Payload ID: 19697
  Gene Name: zinc finger and BTB domain containing 7C
  ENST ID: ENST00000590855
  CDS Start-End: 498-572
aggaggacgccaggactgcgtcccggagccaagtgcgggaggcgcgcagggccggcggcgcgcggagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaaccacagcagtgaggtcctgtgcagcctcaat

SEQ ID NO: 201111 - DNA, 596 bp, Homo sapiens
  Payload ID: 19697
  Gene Name: zinc finger and BTB domain containing 7C
  ENST ID: ENST00000588970
  CDS Start-End: 522-596
aggaggacgccaggactgcgtcccggagccaagtgcgggaggcgcgcagggccggcggcgcgcggagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgctttctttgcttgtttgcttgttgcaagcgccccggggagacactgtgaagcttggcctcctgcccctgtgtctgtctgttgagtcgcaggaagctggcggccctccttcaggagtgggacatgggaaggaggctgcagatcgacctgggaaagggctctggctgagaacatggccaatgacattgatgagctcattggcattcccttccccaaccacagcagtgaggtcctgtgcagcctcaat

SEQ ID NO: 201112 - DNA, 347 bp, Homo sapiens
  Payload ID: 19697
  Gene Name: zinc finger and BTB domain containing 7C
  ENST ID: ENST00000586525
  CDS Start-End: 273-347
aggaggacgccaggactgcgtcccggagccaagtgcgggaggcgcgcagggccggcggcgcgcggaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaaccacagcagtgaggtcctgtgcagcctcaat

SEQ ID NO: 201113 - DNA, 570 bp, Homo sapiens
  Payload ID: 19697
  Gene Name: zinc finger and BTB domain containing 7C
  ENST ID: ENST00000589619
  CDS Start-End: 496-570
ctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttacagagctgctctaagctgtgggccaacaggaggctgggagctctcctctaaattgctttgtgaccttggacaagaaccctccccttcctggactgcaaatttcctcctctgtaaaatgaagggttggtgaggaacttaggtgctgtcttggccaagttcagaaacatgtaggacattatggagaagtgttaaagccagggctctggctgagaacatggccaatgacattgatgagctcattggcattcccttccccaaccacagcagtgaggtcctgtgcagcctcaat

SEQ ID NO: 201114 - DNA, 548 bp, Homo sapiens
  Payload ID: 19697
  Gene Name: zinc finger and BTB domain containing 7C
  ENST ID: ENST00000591526
  CDS Start-End: 504-548
tccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttagctgctctaagctgtgggccaacaggaggctgggagctctcctctaaattgctttgtgaccttggacaagaaccctccccttcctggactgcaaatttcctcctctgtaaaatgaagggttgatgcaacaactgaggcatagagaagtcacttgcccaaggtcacccagcagggctctggctgagaacatggccaatgacattgatgagctcattggcattcccttccccaac

SEQ ID NO: 201115 - DNA, 4949 bp, Homo sapiens
  Payload ID: 19697
  Gene Name: zinc finger and BTB domain containing 7C
  Uniprot ID: A1YPR0
  ENST ID: ENST00000588982
  CDS Start-End: 503-2362
gcacaacaggaacagagggaaaggctttgtcttcaaaggtgtcccagcagttacaacaaggactagagcaggtgctgatgaggccgcagtttgggagtctgatccctaacaaggccaggtcccctctctctgcccaagtttgctctctgaatacagaggaggacttgggccatagagtatgggcagctccgcagggcgattcttgctcatcactggacactcattgtctctgaaggacgggctacgtcggagtgttgtcttagattcgaatgcatgaggaactggaataatcagtaacatttctcccagacagagctgctctaagctgtgggccaacaggaggctgggagctctcctctaaattgctttgtgaccttggacaagaaccctccccttcctggactgcaaatttcctcctctgtaaaatgaagggttgatgcaacaactgaggcatagagaagtcacttgcccaaggtcacccagcagggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtggggggaggggtggttgtgtttttgttttgcttcaatttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaagaaaaaaaaaaaaacctttgacccttattttatactttaaaggacagtgttttgagtaaaagtgagctatgcttgctta

SEQ ID NO: 201116 - DNA, 565 bp, Homo sapiens
  Payload ID: 19697
  Gene Name: zinc finger and BTB domain containing 7C
  ENST ID: ENST00000588149
  CDS Start-End: 510-565
gcctccgatgtactaccaaggagggcgagggttcctatgtctgtctggagcgcagaggggtggactgcaaaaagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgtgccaggcagcacctggaagctctgggaaatccacgagaagcagcaggcattggctctgttttggaggagctttcagtccagttcaggaagagaagacacctgcatatgagacaaagaactttatgaccagggctctggctgagaacatggccaatgacattgatgagctcattggcattcccttccccaaccacagcagtga

SEQ ID NO: 201117 - DNA, 312 bp, Homo sapiens
  Payload ID: 19698
  Gene Name: zinc finger and BTB domain containing 8 opposite strand
  ENST ID: ENST00000341885
  CDS Start-End: 1-231
atgaagggcggaagtagagtgtctaatcctgcagtcatggcgcaggaagaggaagatgttagagattacaatttgactgaagaacagaaggcgatcaaggccaagtatccgccagtcaataggaagtacgagtatcagcagacccatcttctacaatctccacataggatctattctcatcttcactcaagtgccatctggaatccttatctccatctgatggggacataagatgttgttcagcttccaagtcaatggggaggctgtctatgccaaattctgcaagacactcattacacagtctgtagcgcc

SEQ ID NO: 201118 - DNA, 598 bp, Homo sapiens
  Payload ID: 19698
  Gene Name: zinc finger and BTB domain containing 8 opposite strand
  Uniprot ID: Q8IWT0
  ENST ID: ENST00000373501
  CDS Start-End: 171-566
cgcaggaagaggaagatgttagagattacaatttgactgaagaacagaaggcgatcaaggccaagtatccgccagtcaataggaagtacgagtatttggatcatacagcagatgtccagtgagtatagcgggagttcattcctttgaaaccacgtcagtaggaagactgaatgtttcaatcttggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 201119 - DNA, 514 bp, Homo sapiens
  Payload ID: 19698
  Gene Name: zinc finger and BTB domain containing 8 opposite strand
  ENST ID: ENST00000436661
  CDS Start-End: 1-442
gggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 201120 - DNA, 1601 bp, Homo sapiens
  Payload ID: 19698
  Gene Name: zinc finger and BTB domain containing 8 opposite strand
  ENST ID: ENST00000468695
  CDS Start-End: 20-559
ccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttcttttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttgaaaaa

SEQ ID NO: 201121 - DNA, 620 bp, Homo sapiens
  Payload ID: 19698
  Gene Name: zinc finger and BTB domain containing 8 opposite strand
  ENST ID: ENST00000473294
  CDS Start-End: 1-237
gcagtcatggcgcaggaagaggaagatgttagagattacaatttgactgaagaacagaaggcgatcaaggccaagtatccgccagtcaataggaagtacgagtatttggatcatacagcagatgtccatggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggagacagggtgttgctatgttgtcgaggctagtcttgaactcctagcttccggcaatcctcctgcctcaattttgcaaagtgctgggattacaggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 201122 - DNA, 769 bp, Homo sapiens
  Payload ID: 19698
  Gene Name: zinc finger and BTB domain containing 8 opposite strand
  ENST ID: ENST00000479075
  CDS Start-End: 339-509
cgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagttggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggt

SEQ ID NO: 201123 - DNA, 588 bp, Homo sapiens
  Payload ID: 19698
  Gene Name: zinc finger and BTB domain containing 8 opposite strand
  ENST ID: ENST00000476493
  CDS Start-End: 1-171
agagtgtctaatcctgcagtcatggcgcaggaagaggaagatgttagagattacaatttgactgaagaacagaaggcgatcaaggccaagtatccgccagtcaataggaagtacgagtgtgaatttggatcatacagcagatgtccatggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagact

SEQ ID NO: 201124 - DNA, 541 bp, Homo sapiens
  Payload ID: 19698
  Gene Name: zinc finger and BTB domain containing 8 opposite strand
  ENST ID: ENST00000498691
  CDS Start-End: 1-218
ggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggaagttgtgtgctattgttttctagaaaaggttgtaaaggccaggcgcggtggcttacgcctgtaatcccagcactttgggaagccgaggcaggtggatcacctgaggtcaggagttcgagaccagtctgaccaataaggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 201125 - DNA, 548 bp, Homo sapiens
  Payload ID: 19698
  Gene Name: zinc finger and BTB domain containing 8 opposite strand
  ENST ID: ENST00000465588
  CDS Start-End: 212-544
cgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagaca

SEQ ID NO: 201126 - DNA, 766 bp, Homo sapiens
  Payload ID: 19698
  Gene Name: zinc finger and BTB domain containing 8 opposite strand
  ENST ID: ENST00000373506
  CDS Start-End: 1-508
aagtagagtgtctaatcctgcagtcatggcgcaggaagaggaagatgttagagattacaatttgactgaagaacagaaggcgatcaaggccaagtatccgccagtcaataggaagtacgagtgtgagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtgg

SEQ ID NO: 201127 - DNA, 817 bp, Homo sapiens
  Payload ID: 19698
  Gene Name: zinc finger and BTB domain containing 8 opposite strand
  ENST ID: ENST00000492007
  CDS Start-End: 1-266
gagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttcttttttttttttttttttgagacggagtctcgctctgtagcccaggctgaagcgcagtggtgtgagctcggcttactgcaagctccacctcccgggttcacgccat

SEQ ID NO: 201128 - DNA, 1943 bp, Homo sapiens
  Payload ID: 19699
  Gene Name: zinc finger and BTB domain containing 8A
  ENST ID: ENST00000316459
  CDS Start-End: 228-1250
caaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaatggagataaggattccagatggcacttgagtgaagatgagaatagatcctatgtggagattgtagaagatgggtctgctgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaag

SEQ ID NO: 201129 - DNA, 7075 bp, Homo sapiens
  Payload ID: 19699
  Gene Name: zinc finger and BTB domain containing 8A
  Uniprot ID: Q96BR9
  ENST ID: ENST00000373510
  CDS Start-End: 230-1555
agcaaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctgctgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgttaaaaaaaaaaaaaagtagaggctggccaaagattatatacagatattttcttaaagcaggaaactaatgttgcctaaaagtcaaggtagtttgtgaagacaatctgtcaatatggttgtccatctctctaaagaaaagcaggctgggcgctgtggctcatgcctataatcccaatactttgggaggccgaggcaggcggatcacaaggtcaggagtttgaaaccagcctggccaacatggtgaaacctcgtctctactaaaaaatacaaaattagccgggcatggtggcgggtgcctataatcccagctactcgggaggctgaggcaggagaatcgattgaacctggaaggcagaagttgcagtgagccgagatcacaccattgcactccagcctgggcaacaagagcgaaactccgtctcaaaaaaaaaaggaaaacaaactaggaggttcttaccatatgtgagtgatttctaacgtttatgtagtgctatattatttataaagtactctctcatgtattttctcagtgaggtggatactatctccgatttacaaatgaggaaattaaggtcagaaagtctgagagagaaaactgatgattggacaggatctgattttaaacaatcctctttcagccttctctccctgtatgtctcctgaaatggcaaagaatagaagtcaaacctcaccagttggcagtcattataaaaataagccaatcagaattagaaagtatgaaaggaggaattgaatcattttcaacaacatacaatatcttgatctagagattttcaaataatgctaagtaatgtccctacagtacctattggtatgtttttatgtcacgttatttatatgtaaatttaaagtataaaactatttgaacaaattattcacttaaatatgttgaacatttttgcttctcttgtttatataatattttcaaaacaaacttttctcctagtatacaaagtttaaacttctcccctttgggctgggcccagtggctcacgcctgtaatcccagcactttgggaggctgaggcaggtggatcaccgaggtcgggagtttgagaccagcctgaccaacatggagaaaccccgtctctactaaaaatacaaaattagccgggcgtggtggtgcatgcctgtaatcccagctactcagaaggctgaggcaggaggatagcttgaacccaggaggcagaggctgcggtgggctgaggttgcgccattgcactccagcctgggcaacaagagcgaaactccgtctcaaaaaaaaaaaaaaaaaaaacttctcccctgcataaattatgaaacattccaaaattacagctaaattagagaagcattgtttcagttctaaaggtaaaatctaaatatccgaagtaaagaactgagcttcataaaggtctcttctgcaagttatcacagtgaagcttgatagaatttcactgtatatggagaggctccatctattttactgttttcttttttgtttttgtttttttttcgagacggagtctcgctctgtcgcccaggctggagtgcagtggtgcaatctcagctcactgcaagctccacctcccgggttctcgccattctcctgcctcagcctcccgagtagctgggacttacaggcgcccaccaccactcccagctaattttttgtatttttaatagagatggggtttcaccgtgttagccaggatggtctcaatctcctgatctcgtgatccgcccccctcggcctcccaaagtgctgggattacaggcgtgagccactgcgcccagccaattttactgtatttttaaatgccatgacatacctcaaaattatcctttttatgttactattttctcttgttctttcattaattattgtccttgataccaatttctaggctaaattggttactttcttttaaaaaatttaaaaatagatgaataaccacttgtttcatggtacttaattgagactttttcaagattcccctgatggcacatttgcagttgcttcaagactggatgatgtgcattgagttctctgttctcccaacatggctgttcctaaatcaggattctggtttttttgagatggactctcgctctgttgtccaagctggagtgcagtggcgtgatctcgctcaccacaacctctgcctcccgggttcaagcgattctcctgcctcagcctcctgagtagccgggactacaggcatgtgccaccatgcctggctaatttttgtatttttagtagagacagggtttcgctatgttggccaggctggtctcgaactcctgacctcgtgatctgcccgcctcagcctcccaaagtgctgggattacaggcgtgagccagcacgcccggcctaaatcaggattcttaacaattaaagtgtatctgaatgaggaaggaaacgcttgtcattctctagtcttacccaattaatactgacaccttttgaaattaaaacctgattttttagttgttggagccagtaggaaaaatggctgatttgaacttttttcctataaatgaagtagtgcttgcatgtgtgtactctaatgcactttagtctatgatctaaatgtccttttatgctattatcttctgcatgcaaactttacatacatcagcatgaatatccaacattcactgaacacagtgccaccagcacttgtaattgccttttcagaaataatgctttctcataattgtttataacgagcatcaaactatccccacaaaatgatcaagttcaccaaactagacaaagaatctgttgtatcattttaacatcatagaagaacatttaagacatgtttgtaagttgtaaataatgactccagttatagcatatatatctaagacgttagagaccagttattttctagagtgaaactgtctattgatgattgagaaaattgaattctttggtttttacatgtgggcaaatgttacataggggtataatctgtttaaataagctttatttatgccaaggattttttttttaatatcaagacttggttagaccaaagtttgctcttgcaggaatgccatttatcagcttctgaatgcccttctaactccattaccctcaagagtgtctgggtataggatgaagcattacaaaaagaaagcaccactgcagtcatgcctagtgtctgggagaaacaaaatggactagacctgcagtttaaaataatttaacccgagaaactcttcaaatgaattgtttcctaaagatgctcaaatttaagggataaactctaaaatcagagctgctgtggttaaagtcccccacaaacctttccccagacacctctgcagaactcaggtgcacaatgttgaaaaccatggaattagacaacttcctgaattccctttgagccttgcagcctcatttcgttactcctgttactcacggtgcttataagcaggtaaccatatggtctcttagtgaagcaaatcacatccttagcacatgatgttccttctatgggtatcagatcttaagactttttaaaatttaggaacaaatgtttcaatattatattttcagtaatgcaatcaaaataagcatagttactgttttctgtacggctaagtactgcctaatggatgaaagaagtttggtgcttcaattatttatgagctcagaactcaattcattaaagttattttgccaagtcatgccaagatatattgaaatttccactcatattggtttttaaaattttttttagtcctaaaattaataagtatggaaaatcactaaaagcagtgtaggataaggtgtgtttaactggccgggcacggtggctcatgcctgtaatcctagcactttgggaggccgaggcgggcggatcacttaaggccaggtgttcgagaccatcctggccaacatggtgaaaccccgtctctagtaaaaatacaaaaaatagctgggcatgatggtgggtgcctgtaatcccaggtactcgggaggctgaggcaggagaatcgcttgaacccgggaggtggaggttgcagtggccgagatcgcaccactgcactccagcctgggtgacagagcgagactccatcaaaaaaaaaaaaaaaaaaaaaaaagatgtgtttaactgggaagggtgataataatagaataataggtacaggaggaccaaactttagattataaaccagaaagttttgttattttatataagtgtatcagtattactatttatcatttatatagcattttatatttgcaaagtgtttaataatttttgttattctttacatatatatgaaataggacagttatcccacatgaacggtaaataaattgaggcacagaacagtaaaaaaacctcagggtcaggcgtggtggctcacacctgtaatcccagcactttgggaggccaaggcgggtggatcactttaggtcaagagttggagaccagcctggggcaatatagtgaaaccccttctctactaaaaatacaaaaattagccaggcatggtggtgggcacctgtaatcccagctactctgggggctgagacaggagaattgcttgaactcaggaggcggaggttgcagtgagccaagatcacgctactgcactccaggctgggtgacagagcgagactccacctcaaaaaaaaaaaaaaaaaaaaaaaaaagaacctaagacaacccagtgaaatggtagcaaaaaataggaaatataatgatcacattttctgaatcctagaccatcagcctaattcactgaggtgtgttgtgtatcactctattttatagatgattttatataagtaacagtggattgttttaaagctgacgtcattgtatgtggatacattctatatggaataaatgttatgtaaag

SEQ ID NO: 201130 - DNA, 12834 bp, Homo sapiens
  Payload ID: 19700
  Gene Name: zinc finger and BTB domain containing 8B
  Uniprot ID: Q8NAP8
  ENST ID: ENST00000609129
  CDS Start-End: 79-1566
ggtgctccgtggctgcgctgctggaacccgctggaagagatacaggtttgctctggagcagcagcagctggcggagcaatggagatgcaatcctattatgccaagcttttgggggagctgaatgaacagagaaagagggactttttctgtgactgcagcatcattgtggaagggcggatcttcaaggcccacaggaacattttgtttgctaacagcggctacttccgagccctgctcattcactatatccaggacagcgggcggcatagcaccgcctccttggacattgtcacctctgatgccttctccatcatcttagatttcctctattctgggaagttggatttgtgtggggagaatgtgattgaagtgatgtcggctgccagctacctgcagatgaatgacgtggtgaacttctgcaagacatacattaggtcatccctcgacatttgccgaaagatggagaaggaggctgctgtggctgcagcagtggcggcggcagcggcggcggctgcagcggcggcagcagcggcggctcatcaggttgacagtgaaagccccagttcaggccgggaggggacctcctgtggtaccaagagcttggtctcctctccagccgagggagaaaagagcgtggagtgcctgagagagtccccttgcggtgactgcggagactgccaccccttggaactggtggtgagagacagccttggcggtggctcggctgacagcaacctctctactccacccaaacggatagagcccaaggtggaatttgatgctgatgaagtggaggtggacgttggtgaacagctgcagcagtatgctgccccgctgaacctggcccacgtggaggaggccttgccaagcggccaggcggttgacttggcttacagcaactaccacgtgaagcagttcctggaggcgctcttgcgcaacagcgctgccccgagcaaggatgatgcagaccatcacttttctaggagtttggaaggaagaccagaaggtgcaggagtagccatgagttccatgatggatgtccaggctgactggtatggagaggactcaggtgatgtgctggtggtccccatcaagctccacaagtgtcctttctgcccttacactgccaaacagaagggcatcctcaagcggcacatccgttcacacacaggcgagcggccctacccctgtgagacctgcggcaagaggttcactcgacaagagcacctgcggagccacgcactgagtgtccacagatccaaccgtccaatcatctgcaagggctgcaggagaacattcacgagtcacctgtcccaggggctgcggcgcttcgggctgtgtgacagctgcacctgcgttacagacacacccgatgatgatgatgatttgatgcccatcaaccttagcttggtggaggcttcatctgaaagccaagaaaagagcgacacagacaatgactggccaatctatgtggagtcgggtgaggaaaatgaccctgctggagatgattctgatgacaaaccacaaattcagcctaacttatcagaccgagagacacttacgtagcaataaattggtggggaagaggaggttttaaaacttgttagtgctcgttctgttgttgaaagataccatttgtccaattttgtggaaccctgagaggaacattttttcactgttattatatgtgcatttttattagactatctgatagaggttggattttgtgactcaaaggacagataacctttttgtgtggtgcccttggtttctgagggctttgctggccactccttaattctgagtgagtcaaagcaggccctgaggtctcctgtttttcttgctgtgtgtccaaactctggttaggagaaagataagaaaatctccaggcttgtttttatattgattcagtcctctgcattcctttgttatcatcctctttctctaaaaaccattaagttttgggatcaagtttacctttgccaagcctttcctaatgaattccacattaaattttctggcaaagtattaaagagaaaccttcattgatataaagcaggcagggcggtctggctacatgatcataaaaggtactccctaaatctagaacaattttaaaggcttggaatacttatgggcagacgaacatgggaatgatctgaaaggctcattatggcatcctgacttgcccagttgaattaaattttaagttagccctgagaagggaggctatgaccccaggtctggatggtttccctgtctggtttggcatttgacgattctacacatacaacctgttctgttatcataaaacaactcatttgggcaaaactcaaaatgctcccctactttttccagcaatttccaaaagctggagctgtgtaacttggaaatgtagctgcctctggcattcttttacttagtttatgctgatgtagggcaggtgagcccaaaaattggggcttagcccagaggagttcttggcttcacccaggaaagaattcaagggcaagccagtggtgttagacagcagcttgtattgaagcagcagtgcccaacagcagctaaggggccgctcctcgtggagcagggctacaccataggcagtgtgcccagagtagtagctcagaggcaggtcggcacttatatttatacccacttttagttacatgcaaattaaggggcagattatgcagcaatatttaggaaaatggtggtaacttccaagccgctgggtggttgccatgataaggggcagtgacttccaggtgttgccatggcaatggtaattgacatggcacagtgataagtgtttcttatggaaatctgcttcctgcaccaccctcccaccaccgccctgttttagctagtcctcaatttggtccatgtccgagtccggcctttggagttgagtcctgccttctacctccttgcctagaactttaattggagggaaagtataagcccataatgccaagtaacatttctaaaatgttcatcttttaaaagatcttcatgagggaaagggaaggttagtagcagaacaggtttttaaaagcagtctacctttcgcccactttccagccacacaattattgtaacaaaagaggctgaactctttaaagggctaaagggcaggcagtgttaggaattcggaatgtaattgaaggcaatttccataattttgtcttatgttaaaatatccaaaatggattttaaaagaaatcttcttgtcttcctttaagtgtagttgtctttcaaaaggtggtaaaagtcacttttatttctacctcttgaacaacaaaaaagtcaaaaacattataaattggcttgtaaatgttagccaaagcattagacaggtgtttaagtcgtacttctcaatagtagttaaaactggaacagtgcaactcaaactctggcccacagagaggccctgttctgtaaactgttttctaccagtctgctacaaggaaagtcagaaattaagaatacacatatagaaatgttgataacactttgacattgctgtgactcatggctttgtcttcttgagtgaggtatggaccagttcagttctggtcagctagagggccacatggtgcagaggttggataccagcctgtacagcaggaccacgtattggtctgcagtagaatggaaaatttaaaacttctcttatcacaggtagttcgataaatatcattcttggctgtgtgcggtggctcacgcctataatcccagcactttgggaggccaaggcagatggaacacttgaggtcaggagttcgataccagcctgaccaacatggcgaaaccccgtctctagcaaaaatacaaaaattagtcaggagtggtggcatgtgcctgtaatcccagctactcaggaggctgtggcgagaggaacacttgagcctggaaaaggttgcagtgagctggaatcgtgccactccactccagcctgggcaacagtgtgagaccttgtctcaaaaaaataataataaaataaataaataaaagaaaaatattctagatcaagagttactcattgaaaattatcagggaccagagatatttgtcttatctgaaataaaaatactagctgtggccaggcgcagtggctcacgcctgtaatcccaacactttgggaggccaaggcaggtggatcacctgaggtcgggagttcaagaccagcctggccaacatggagaaaccccgtctctactaaaaatacaaaattagccaggcatggtggcgcatgcctgtaattccagctactcaggaggctgaagcaggagaatcgcttgaacccaggaggcggaggttgctgtgagccgacatcacaccactgcactccagcctgggcaacaagagcgaaactgtctccaaaaatgtatacatatatttgctgttattttaaaagagggatctcagcaaaaaggaaacctaaatggatgtgtagaagatttacttggccaggaacagtgtttgatatttttgctttctctgtttaaattatctctgatgttttaatgacttttctacctcatagttcagcctctttgcctgctttctccagtggagctatgatcctcttcagtgattccgtgacctcttcatatccctgggtaaaacattttacattagagatttcactgtaggacagtgattctcagttgggggtgatttcgtgccttgcaggtggctactggcatctagtgggtagaggccagggaagctgccaaacatcctgaaatgcacaggacagtccccacaacaatgaattctccaattcaaaatgtcagtaataccaatgttgagaaactctgctgtaagataaagtaggattttttaaaggatctttaatgagtggacttaattttgtgttctattttaagctaccttttacctgcataatatttatttatttttaattttattttatgtatttatttatttattttgagatggagtttcatctttgtcacccaggctggagtgcaatggcgtgatctcggctcactgcaacctccacctcccaggttcaagagattcttctgtctcagcctcttgagtagttgggattataggcacgcgccaccacgcctggccaatttttgtatttttagtagaaatggggtttcaccatgttggccaggctggtcttgaactcctgacctcaagtgatccgcctgcctcagcctcccaaagtgctgggattacaggcgtgagccaccgtgcctggctgaccttcataatatttagtagccccttatactctcgcaaattttagaaaatagtggattagtaaaatgaagcgctgaggccagatggttcatagcttgcccaagatctgatttaggtttataatgtggaaacttagaaaattctgactcattcatacacccagaatcgttactaggttctgatcattttgttaatttttaaagtagcagaatcactgggaagaaaacagaatgtgacacctaatgtttaaatgattctctttctttcgtaatatctcagattgttgcatttctggtggactatttggagtttgtgtataggcactggcaataactggatcactgagttctatcacttttaaaggagatacttcctctgtctagactatcagatcataaattggtcccctttaggtggtcagtatttataatcacagtgtctttgaggtttaatttgtggggttggtggtatttttatactaagtaaatttacagttgagcccaacacagaccgttagtggtttagtttctattctggcacattccacccaagttcacaaagggatattttcgtctcatattagatgtattgcatgaatgggaacaggactcttacttgtaatggaattccaaaatggcattcttgggaagttatttctcttgggggatgaggacccccttctcaaaagttgagaaggaatgtaaatagggccttacctataataattaagaaatgacatagtgcatcatgattctgatcatttggcagaaagatgccgttctgatgtaaatattttggtggccaccagactttgaatattccttaaggaagctgctgacctagtgttctgcaacatgttatggaattgagtattctggtggtttggaatactgagatgggttttttttgttattgttcattgatgtcgtgacaaaccccagggagagaaaggcaacaggtagggctgcatgcactgattctgggagccgtaggaaagagtggagtggcctttggttaactgaactcagactgttttatttggaactctagatttttcttgtgtgtgtcccttgtgcattaagagaatgatctctgtgaagtctagtgtaatggggtagggaggggcaaagggttgggatgggtgagaagttcctattatgctctgttttgagcattcccactgtgcttcctgttgttgctggtctcttgtagcttgccttgtgttttcatgtgatcacactatcttctaacctgataaagggacactttattcaggtgcatatgatgggcactgttttcattgatttctgttgcttttgtagttctctccactcaacagtactgtgttccacaaacctttcattgtagtgctggaaatttgaattcttttcttcaaatgatgtttctgtagagaaaaacgaaaagtgttttggggtcagagtagtttggttggttcctaaacatgtcctagtttttgttgttgttgttgtttttcttttctttttttttctgagacggagtctcgctctgttgcccaggctggagtgcagtggcacaatctcggctcactgcaagctccgcctcctgggttcatgccattctcctgcctcagcctcctgagtagctgggactacaggcacccgccaccatgcccagctaattttttgtatttttagtagagacggggtttcaccgtgttagccaggatagtctcaatatcctgaccttgtgatccacccgcctcggcctcccaaagtgctaggattacaggcgtgagccaccgcgcccggcctaaatatatcctagttttaaaaggtgacagtaactcacatgactgcatgatcggatgacatggaaacttcataactgaaggagaacatttagcatccgtcttgaccctccaggtagattattttactactgccaattcttcattgacaattgtggttttagggggggcaatttttatatccatcatttgatttctggacctttgtcagttaatcagtggaggttagggcagggattatgtgctttgatgaggaaggtttagtagtaacaagcttggggattttgaaggaaggcatcaatttcatatacaggtcttggtgacatgtaatggatatggattatctgtcatgcatacagtgaagggtatggtcaggatttttttggaagtagaaaaacataccaaacagtttcacatcttttaccatccatagcccctgaggagcatctactgccatcagaaaaacatgcaaataatactgcagtgccctccaagggtcttaggcccaactgaaggtttagaaacattcaaatttataaactgccacacttggcatcagattcacttaaaaggatatagaatgggaagcactgcttactagcaaggcagaaccagttgctcttctctgaaagtctctgcagctgtctgtgtggcatagtgcaggtgcaaggagacagatctacatggggcaagtatggaagcttccccggcttaagagccccttgtcccacaggaacaagtatctcttataacagcttcatagacatggcctccagtgtccctataaaagacatgcctgttccaagcgtcactgtacttagggatgcccagagctgaggcttcctatcaggcatttatagttctcccagtccagatgcagtttaccaattgggcatcatgtctaccatatgtaacattgcctagcagttgacatatgaatttttattaggttgccaggggaacagagctagaaagttaacaaaggtaaaattctcatgcagaagggaaagaggctttgttaatactttgccaaacactatgctaagcaattgcataacagatattacacctaattcctatagaatatagccagaggaatttcctagtaaaatataacccaccctaactcatttttcctttcttgaatagtgttgttggtgcttagttgcttgtgattaatagacagtttgcaaattttggtaaggtgtgtgtaagagttggcttaacagtcaaaatgatcctagccaaaatatcatgtatcctttggtgtcactcataataggtgagtatagtatgtcgtactgtagggacattattgaatggacatgtctgagtattccatcagtcatattttgatgggagcctttggccatctggcaaacaccaaacacaggctcttggtaaccgtgcctttttttttttttttttttttttaaagatggagtttcactcttgttgccaggctggagtgcagtggtgcaatctcggctcaccacaacctccgcctcctggattgaagcgattctcctgtctcagcctcctgagtagctgggattacaggcgcccgccaccacgcccggctaatttttgtatttttagtagagatagggtttcaccatgttggtcaggctgatctcggcctgacctcaggcaatccgcctctgcctcccaaagtgctgggattacaggcgtgagtcactgcgtccggcctgctcttggaaaccgtgcctcttattcctgtgtcatgtggtgctactcttgcctgcttctgttgctcccagcagatcaatgagtgaagatggctggttactcattcagtagttatcaaacaattatttatggagtctttactgtatgtcaagcacgaagggtacttcagtgaaccagcaccatccctgccctcaaggatcctgcagtgtgtaatcacagagactggcagttataacacggcatgttgggtgtgacaacagggacaagcacagggtactctgagaacgcgtgggtcgggtacctagccagtcatagagcctcagagacgctttctgtctaagctactcttcctatccagtaaacttccagctttggcatactatatttataagcagtttaaacagttgctgaaatttattgccttttctcaaacatggtggctttggtcactaacagtgtttaaattatgtgttttattcagttatgcaaaaatatatactatacatagaatatcagaatgttgtagtctttaggaaatatgcatcaggtttgttttttttgtttttttgacagactctcactctgtcgccaggctggagtgcagtggcgcgatcttggctcactgcaacctccgtatcccaggttcaagtgattcccctgcctcagcctcccgagtagctggcactacaggcgtgtgccaccacgcccagctaattttttgtattttataagagatggcgtgtcaccatgttgaccaggatggtcttgatctcctgacctcgtgatctgcctgcctcagcctcccaaagtgctgggattacaggcgtgagccactgtgcctgactgggtggttttcttttttaaaaaataatatggttttctggccgggagcagtggctcatgcctgtaatcccagcactttgggaggtcaacgggggtggatcacctgaggtcaggagttaaagaccagcctggccaacatggtgaaactccgtctctactaaaaatacaaaacaggagaatcgcttgaactcgggaggtagaggttgcagtgagctgagataatgccactgcactccagcctgggcgacggagtgagactccatctcaaaaaaataaaaaataataataatatggttttcttatttaaaaaataatatagtatgtaaattatttttcaagtaaaaatgaaatgacaacaacagataacttcccattatgttgatccagtgtactgtgacagatggggaggagccccactgcatctggagtgggtcttggctggccatgtgaactaattaataccccagaaatcaggatacatgccaggcgtcggggcttacgcctgtaatcccagcattttgggaggctaaggtgggtggatcccttgaggtcaggagtttgagaccagcctgaccaacatggtgaaaccccatctctactaaaaatatacaaaattagcctgtaattccagctacttgggaagctgaggaaggagaattgcttgagcccaggaggtggaggttgcagtgagctgagatcacaccactgcacttcagcctgggcaacgagagcaaaactccatctcaaaaaaaaaaaaaaaaaaaaaaaagaaatcaggatacatataggacagaaccattaaatcaagagatttgaaagttagaagggacaggagagatagtctagtccaactccatgtgacagatgaaatgacgtttctagttctcacacagctggttaggatcagaaaccaggtcctgccaggccagtcctgataatagacagacatgtttgggcaggcagaaaagaccattcatagataacatttgtttccctgggtatccatcagaccagaggcacaggagaggaaaatgctgttttggcctcatatgataaagtatgcattgtgtgattatggtctgcattcttgcaatgcttagacagggagggggaaatcacattttgagcatgggggagttaatttctttgtcctgtaataccacacatatctaaaacataaaccaccatggaacacactcacactcacatacacacaaaaggcaaattaaaatatttattgtccacttaatatgtgttctgtgtttgattgtaatgtattcattttacttataaaaaatttcaaaagtaaaaatatatatattattaacttgaagtgattttttccaacctcgctgatttttttccttctttcttttttgagacagagttccactctgtcacccaggctggagtgcagtggtgcaatctcggcccactgcaatctccgcctccagagttcaaagagttctcatgcctcagcctcctgagtagctgggattacagaggtatgccaccatgcccggctaatttttgtatttttagaagagatggggtttcattttggtcaggctggtctcgaactcctaacctcaggtgatacacccgcctcagccttccaaagtgctgagattacaggtgtgagccaccatgtccggcctctaactgatttttgaaatataaattgggtgtgattcagggaatgtaacaagaacaatcttatttgaaacagaaaaccacatatttttaagtcagcagcccacatgataagatggtattgagtaaaaatgtattcttaggtatttcttgactcagtggattttaatcagtctactgcaaaagctagttttatttaaagggctgcaattatatataagaattattagaaaaacagattagccacttaatctaaaaatacctagatgcagtattcctggtttttaatgaaatatttatctagtttgggattaaaattaacttagggccatcaaaaatgcaaattatctttaatttggttaaatcaacctgggagtaaatggaaataatctcaagctaaatttttgttttgatttatatacagtcagattgaaacaccctagttacaagtttagaataggagtggcctcaacaaaggaaaaagtcctttgttcctctgttgctcattttgtcctcggaaacaaatacaatttaactattttctgtaccgtcccaaatttgaagctgacctgaatttggtacctataaatttaaaatggctaaggttaaaatagttaaaacagtttctttagaatgagttgttagctgggtgtggtagtgtacacctgtagtcccagctactccaaaggctgaggcaggaggattgcttgagcccagaagttcaaagctgcagtgaactaggatcatgtcaccacactccagcgtgggcaacagaatgagaccctgtctcaaaaaaaaaggtttttttttaattgaatgaatgcaataaggaattgaggatcgtctcacattaatgagtgaataacccttcataattttagttactgtttttctcagggcaattattttatataaaattctaatggagaattttatggacaagattttagttaaggaaaaaaataaccccacaaaataaagagaactattagagctctaaacagaagaagcttccatcaaaccgtttttcccacttttttgtcccacggtcttaggaccaacaatttagtaatacgagacaatttctggcagactatcccaagctgggacattttagattctgtgaaagaagactgactactgtctgatgaatgggtaattgatgatgcaatgtatgaaaaaagtaaggcagacaactcaaaaatcacaggaagtgcagccattctacgtgccgagctctacagttacacactgtccaacagctctcggaagaaaaacagaaactgactttatctttgcctgccaagtttgcaaatggattagttcattacaaaggcacttgtcaaaacatatttattaaaaagaggagccagagttggaaatcatcttgaccattaaaaaaatagcaactgataccttgtttaacaagtaagacagtttctgctttttggaattgaattggtttttaagtggtaatgtaccaggtctgtttatataggtcagtgttgcccaggttgtattgttttgctgtttttacttttttatatataaagaactaaaattacgagagaataaattcgtggatataatctaaa

SEQ ID NO: 201131 - DNA, 2716 bp, Homo sapiens
  Payload ID: 19701
  Gene Name: zinc finger and BTB domain containing 9
  Uniprot ID: Q96C00
  ENST ID: ENST00000395064
  CDS Start-End: 269-1690
ttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtctctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaactga

SEQ ID NO: 201132 - DNA, 2716 bp, Homo sapiens
  Payload ID: 19701
  Gene Name: zinc finger and BTB domain containing 9
  Uniprot ID: Q96C00
  ENST ID: ENST00000414934
  CDS Start-End: 269-1690
ttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaactga

SEQ ID NO: 201133 - DNA, 673 bp, Homo sapiens
  Payload ID: 19701
  Gene Name: zinc finger and BTB domain containing 9
  ENST ID: ENST00000612407
  CDS Start-End: 1-349
catttattcagggcgtctccgcctgccactggatgctcttcctgctcatctccttgtggccagtggccttcaaatgtggcaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcag

SEQ ID NO: 201134 - DNA, 575 bp, Homo sapiens
  Payload ID: 19701
  Gene Name: zinc finger and BTB domain containing 9
  ENST ID: ENST00000621915
  CDS Start-End: 161-575
gcacttggcgacggtgtccggcggggaggcggcggcttccggtctgggacggagctgtagcggcactgtaactgcgagggcagcgccgcccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtctctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattctta

SEQ ID NO: 201135 - DNA, 570 bp, Homo sapiens
  Payload ID: 19701
  Gene Name: zinc finger and BTB domain containing 9
  ENST ID: ENST00000612775
  CDS Start-End: 334-570
atatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatgccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtctctgctggaatctctgaaccgccacaggctagagggaaagttctgtgatgtgtccctcctggtgcagggccgggaacttagggctcataaagcagtgttagctgctgcctctccttacttccatgacaagctgcttctg

SEQ ID NO: 201136 - DNA, 2054 bp, Homo sapiens
  Payload ID: 19702
  Gene Name: zinc finger and SCAN domain containing 1
  Uniprot ID: Q8NBB4
  ENST ID: ENST00000282326
  CDS Start-End: 248-1474
gtgcggggatggggtccgcccgcggcgttgggcgcgctcgccagcccaggggtcgccatgaccgagtggcccaggcccgagcgaagcccgcgcgcggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctcgcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaagttctggtatctctggactcggtcgaaccccaggactggagtttcggtgaggaggaagatgggaagagtccaaggtcccagaaagaaccatcgcaggcgtctgagctgattctggatgcagtggcagcagccccagcactccccgaggaaagtgagtggctggagactacccagctccagcagagtctgcacaccagggcggaggccgaagcgccccgcgcccctggcttgctggggtcccgggcccgcttgcctctgaagccgagtatctgggacgagcctgaggaccttctcgcagggccctcctcagacctgcgggcagaagggactgtgatctcgagccccaagggtccaagtgctcagagaatcagtccccgaaggagaaacaggaacactgaccagagcggccgccaccagccatccctcaagcacaccaaaggtggtacccaagaggctgttgcaggcatctcggtagtgccgcgtgggccccgaggtgggcggcccttccagtgtgccgactgtgggatggtcttcacctgggtcacccacttcatcgagcaccagaagacccatcgcgaggaagggccctttccgtgccccgagtgtggcaaggtcttcctgcacaactccgtcctcactgagcatggcaagatccacctgctggagccaccgaggaagaaagccccccggagcaagggcccccgggagtccgtcccacccagggatggagcccagggcccagtggcccctcgcagccccaaaagacccttccagtgtagcgtctgcgggaaggccttcccctggatggtccacctcattgaccaccagaagctccacacggcccacggccacatgtgaatggccagcctcgggcctcggccacccggccctgagtccctggggggagctgatgggccccagaagatgggggacatcccccagccccaccaacccctggccaccttgggactcctcttgaaggacacaagctgtttctcggaagaccctggacacctgctccgaagccaagcacgggatggggcttcccagggtctcagctgagaagcagcagttccacagcacagcctggtcagtcctgcgcactatagttttgcaagtggcttgaagaggagtttcattcgcgtcccatctttcagaagccttgtccaggtctccctgttagcacctgactcagcggcagcttctgccgctgggttttcatttcactgtggatatccctgaggccatgagggtgggagccggcctgggcagctccaactccagagaagggtacagctgaccccggctgccctcctgccagcttagcccccttggaacctaacagataaacagggttttgtttttttccttttttgggtaaagtacatgcaacataaaatttaccatttcagtcattaaaaatgaacagttcagtggc

SEQ ID NO: 201137 - DNA, 952 bp, Homo sapiens
  Payload ID: 19702
  Gene Name: zinc finger and SCAN domain containing 1
  ENST ID: ENST00000391700
  CDS Start-End: 345-881
agcggaccaatggcggccgcccgcggcgcgcagggtgcggggatggggtccgcccgcggcgttgggcgcgctcgccagcccaggggtcgccatgaccgagtggcccaggcccgagcgaagcccgcgcgcgacctcagcccaggaccctggaggatgctgaggggctacagcccccctccctagagtctccagggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctcgcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaaggtgagaggcgcaggcttcctgccccgggccgggccagggggcctgacgtctccgaggaccgaactgccctccttcccgcccacatcgctcccacccctgcccggcccctcccgaccagcaaacctctcctgccccgcggctgtgtttttaattatttttacatataaatgtgctgcacgcctcatctgcctcgaatttctcactcagtcggtgattaaagatccctccatttcccatg

SEQ ID NO: 201138 - DNA, 813 bp, Homo sapiens
  Payload ID: 19702
  Gene Name: zinc finger and SCAN domain containing 1
  ENST ID: ENST00000601162
  CDS Start-End: 208-744
ccagcccaggggtcgccatgaccgagtggcccaggcccgagcgaagcccgcgcgcggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctcgcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaaggtgagaggcgcaggcttcctgccccgggccgggccagggggcctgacgtctccgaggaccgaactgccctccttcccgcccacatcgctcccacccctgcccggcccctcccgaccagcaaacctctcctgccccgcggctgtgtttttaattatttttacatataaatgtgctgcacgcctcatctgcctcgaatttctcactcagtcggtgattaaagatccctccatttccca

SEQ ID NO: 201139 - DNA, 2463 bp, Homo sapiens
  Payload ID: 19703
  Gene Name: zinc finger and SCAN domain containing 10
  Uniprot ID: Q96SZ4
  ENST ID: ENST00000252463
  CDS Start-End: 89-2266
cagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggattttagttgtaatgctggcaagagttgtccccgtgcagacgtcaccttggaggaaaaggggtgtgcttcccaggtccccagccacagccccaagaaggaattgcctgcggaagagccttcagtgctgggcccatcggatgagcctccccgaccccagccaagggctgcccagcctgctgagccgggacagtggaggcttcccccaagttcaaagcagccgctgagcccggggccccagaagacattccaggccctgcaagaaagcagtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctcc

SEQ ID NO: 201140 - DNA, 2350 bp, Homo sapiens
  Payload ID: 19703
  Gene Name: zinc finger and SCAN domain containing 10
  Uniprot ID: Q96SZ4
  ENST ID: ENST00000538082
  CDS Start-End: 317-2248
tccattttcccagagcccttccccaggctggcggaggctggctttggccctggagtcctcagaaaaccccccagcatctctgcctgtgtagtggggactccgagtggtgtgggaggagaggagagagacccaagagcggggctggcgttagggaggcatccccgcagtgaaggatgcttggagaatcagtcccagctgccgtggagcaggagcagctgggggaagtcaagctggaggaggaggaggctgtcagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctc

SEQ ID NO: 201141 - DNA, 747 bp, Homo sapiens
  Payload ID: 19703
  Gene Name: zinc finger and SCAN domain containing 10
  ENST ID: ENST00000576483
  CDS Start-End: 264-747
ccattttcccagagcccttccccaggctggcggaggctggctttggccctggagtcctcagaaaaccccccagcatctctgcctgtgtagtggggactccgagtgagacgggatttcaccgcgttagccaggatggtctcgatatcctgacctcgtgatccacccgcctcggcctcccaaagtgctcggattacaggtgtgggaggagaggagagagacccaagagcggggctggcgttagggaggcatccccgcagtgaaggatgcttggagaatcagtcccagctgccgtggagcaggagcagctgggggaagtcaagctggaggaggaggaggctgtcagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggattttagttgtaatgctggcaagagttgtccccgtgcagacgtcaccttggaggaaaaggggtgtgcttcccaggtccccagccaca

SEQ ID NO: 201142 - DNA, 2739 bp, Homo sapiens
  Payload ID: 19703
  Gene Name: zinc finger and SCAN domain containing 10
  ENST ID: ENST00000576985
  CDS Start-End: 196-2538
actggggcaaggaacttcctgttccattttcccagagcccttccccaggctggcggaggctggctttggccctggagtcctcagaaaaccccccagcatctctgcctgtgtagtggggactccgagtggtgtgggaggagaggagagagacccaagagcggggctggcgttagggaggcatccccgcagtgaaggatgcttggagaatcagtcccagctgccgtggagcaggagcagctgggggaagtcaagctggaggaggaggaggctgtcagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggattttagttgtaatgctggcaagagttgtccccgtgcagacgtcaccttggaggaaaaggggtgtgcttcccaggtccccagccacagccccaagaaggaattgcctgcggaagagccttcagtgctgggcccatcggatgagcctccccgaccccagccaagggctgcccagcctgctgagccgggacagtggaggcttcccccaagttcaaagcagccgctgagcccggggccccagaagacattccaggccctgcaagaaagcagtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctccaaaa

SEQ ID NO: 201143 - DNA, 2247 bp, Homo sapiens
  Payload ID: 19703
  Gene Name: zinc finger and SCAN domain containing 10
  Uniprot ID: Q96SZ4
  ENST ID: ENST00000575108
  CDS Start-End: 890-2050
attttcccagagcccttccccaggctggcggaggctggctttggccctggagtcctcagaaaaccccccagcatctctgcctgtgtagtggggactccgagtggattttagttgtaatgctggcaagagttgtccccgtgcagacgtcaccttggaggaaaaggggtgtgcttcccaggtccccagccacagccccaagaaggaattgcctgcggaagagccttcagtgctgggcccatcggatgagcctccccgaccccagccaagggctgcccagcctgctgagccgggacagtggaggcttcccccaagttcaaagcagccgctgagcccggggccccagaagacattccaggccctgcaagaaagcagtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctcc

SEQ ID NO: 201144 - DNA, 575 bp, Homo sapiens
  Payload ID: 19703
  Gene Name: zinc finger and SCAN domain containing 10
  ENST ID: ENST00000572431
  CDS Start-End: 558-575
cccccagcatctctgcctgtgtagtggggactccgagtggtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggac

SEQ ID NO: 201145 - DNA, 618 bp, Homo sapiens
  Payload ID: 19703
  Gene Name: zinc finger and SCAN domain containing 10
  ENST ID: ENST00000572548
  CDS Start-End: 140-475
aggctggctttggccctggagtcctcagaaaaccccccagcatctctgcctgtgtagtggggactccgagtggtgtgggaggagaggagagagacccaagagcggggctggcgttagggaggcatccccgcagtgaaggatgcttggagaatcagtcccagctgccgtggagcaggagcagctgggggaagtcaagctggaggaggaggaggctgtcagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggca

SEQ ID NO: 201146 - DNA, 5495 bp, Homo sapiens
  Payload ID: 19704
  Gene Name: zinc finger and SCAN domain containing 12
  Uniprot ID: O43309
  ENST ID: ENST00000361028
  CDS Start-End: 147-1961
tccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagatagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatataggtaagataatatcatccagaatgtggagacgaggcaatcgatgatgctggaaaagttgaagagagagtttgaatgaaggacaaaccaccgatgggaaagcttgggaggatcacttatagcttgactagcaaaaggctttgggaataggatagaaagcagcaaacctgaactttaggatccaccagatgtctctggagccataacccaacatttcccataaatagtaggttttaattctcctgttatttaggtgcatctctgggacctcctctttctatattgggttttttgtttgttgggtgttttaacttaggatttagcttcaaattccatttcccaagaccaattttatcacattgcctttaggtctcaggctaaatgatataacaagatatgcttttggcaaagatagtaccttggaatgaaaggtttcagatcaaacctaagatcctaccttagtttacctctcagtgttattgccttttgatatggaaagctgatgagagagcatctctggagagaaagaagaggagagcctcacgggaagcttttagaacttttagtagcatcctctccccagaaaacttgtctctactcatctccttctcattatctacctgattcgttaagtaggaaatctcagccatatttgtaggggattggggttttgttttttttgacccacttaactcctttagcttcagagtgttgctttcttacattttagacatgaatattacctagaaaatttatttccccactgttaattttccagtttattgatttccccacatcagattagtgtgtattttgaaactggtttagctattgtttcaagttaactttgatcatatcccgttgtttactgatccactcaacaaatatttattgaacattctgtaggtttatagtagtagccaagatacttaaagtgagtagaaatagtccttttaactgtccttaacaaattaaactttctcttggtttcatgatattccttgtttctcagctttggattcaaactgatcttctcttttttgattatactttcctgatttcttttattgtcacatttttgtgaaaagtcttccatgcacttccagtctctttctgcctagctgtctcttctcacccaaattggacccccctactcctaccctgccacgtgccttcacaaaaatgagatgcttgtttagagacttagaaaaggcatgcactttaggtaaaagtggattttatttttaatcactgtaccctatcataaatctcatttcagaagagacaactgacatttgaattgtctgtgcattttgttttagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaagggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcataggtattattaataaattcattattttcaaagatgg

SEQ ID NO: 201147 - DNA, 3909 bp, Homo sapiens
  Payload ID: 19704
  Gene Name: zinc finger and SCAN domain containing 12
  Uniprot ID: O43309
  ENST ID: ENST00000396827
  CDS Start-End: 144-1958
gggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagatagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaagggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagact

SEQ ID NO: 201148 - DNA, 1328 bp, Homo sapiens
  Payload ID: 19705
  Gene Name: zinc finger and SCAN domain containing 16
  Uniprot ID: Q9H4T2
  ENST ID: ENST00000340487
  CDS Start-End: 150-1196
cggcccggaagtgcccggctgaagcggccgggcgccgattggtgtctttgagtctagtctttgttcggggctgtccaaaggacgctagctgttgcacctgttcctccctgcgcgtaagatagaggataaatctcctggcaaagcccagaatgaccacagccctggaacctgaggaccaaaaaggacttctgataattaaggcagaggaccattactggggacaggattccagctcacaaaagtgcagtcctcacaggagggaactctatagacaacacttcaggaagctctgctatcaggatgcacctggaccccgtgaagctcttacccagctgtgggagctctgccgtcagtggctgaggccagaatgccacaccaaggagcagattttagacctgctggtgctagaacagttcctgagcattcttcctaaagacctgcaagcatgggtgcgtgcacaccatccagagactggagaggaggcagtgacggtactggaggatctggagagagagcttgatgaacctggaaagcaggtcccaggcaattcagaaagacgggacatactcatggacaagttggcccccttgggaaggccatatgaatcactgactgtccagctccatcccaaaaagacccagctggagcaggaagctgggaaaccacaaaggaatggtgataaaactaggactaagaatgaagagttgttccagaaggaagatatgcccaaagacaaggaattccttggggagataaatgacagactgaacaaagatactcctcagcatcctaagtccaaagatattattgaaaatgagggcagatcagaatggcaacagagggaaagaagacgatataaatgtgatgaatgtgggaaaagtttcagtcatagctcagaccttagtaaacacaggagaactcacacgggagagaagccctataaatgtgatgagtgtggaaaagccttcattcagcgctcacatctcattggacatcatagagtacacacgggagtaaaaccctataaatgtaaagaatgtgggaaagacttcagtgggcgcacaggtcttattcagcatcagagaatccacacaggtgaaaaaccctatgaatgtgatgagtgtggaaggcctttccgagtaagttcagctcttattagacatcaaagaattcataccgcaaataaactctactaatatagcagtaatatcaaaagttctttggacactcaggcctaactagttatcaaagaatctattttagaaaccttgagtttcctcaatgtggtcaaagcttcagtcatcattaaacttctctggaccaaagaa

SEQ ID NO: 201149 - DNA, 2779 bp, Homo sapiens
  Payload ID: 19706
  Gene Name: zinc finger and SCAN domain containing 18
  Uniprot ID: Q8TBC5
  ENST ID: ENST00000240727
  CDS Start-End: 401-1933
gggcggctgggaccggcctggggtagctgcgcagcaggtgggtcggtcccggggatgcagcgcgggggtcagagagcgaccccaacagggtagacggtgaggacgcctcagtgggcagcgttagggaaaggggccagggtgttcccggggttggggtgcgagcccccgctgtgcgtccaggaggccgagggtctggcatcccttcgcgtggagtgcggggcaggggccgggtccccccggaggtggctgagatccagatcggtgaggggccctgcaggcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataa

SEQ ID NO: 201150 - DNA, 1488 bp, Homo sapiens
  Payload ID: 19706
  Gene Name: zinc finger and SCAN domain containing 18
  Uniprot ID: Q8TBC5
  ENST ID: ENST00000421612
  CDS Start-End: 117-1241
atcgcgcactggggctccgggcggctgggaccggcctggggtagctgcgcagcaggtgggtcggtcccggggatgcagcgcgggggtcagagagcgaccccaacagggtagacgggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaa

SEQ ID NO: 201151 - DNA, 2071 bp, Homo sapiens
  Payload ID: 19706
  Gene Name: zinc finger and SCAN domain containing 18
  ENST ID: ENST00000433686
  CDS Start-End: 1-1224
gataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataag

SEQ ID NO: 201152 - DNA, 2190 bp, Homo sapiens
  Payload ID: 19706
  Gene Name: zinc finger and SCAN domain containing 18
  Uniprot ID: Q8TBC5
  ENST ID: ENST00000601144
  CDS Start-End: 310-1842
gcgtctgattggccatgcgcactgtcacctgtcacggctcccttgctcgccccggtgcgcggcacagcctcgcggcattgtgggagtcgtagtccgcggtgaggcccagtgcgcaggcgcagtttgccggccgccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttc

SEQ ID NO: 201153 - DNA, 558 bp, Homo sapiens
  Payload ID: 19706
  Gene Name: zinc finger and SCAN domain containing 18
  ENST ID: ENST00000601063
  CDS Start-End: 524-558
atcgcgcactggggctccgggcggctgggaccggcctggggtagctgcgcagcaggtgggtcggtcccggggatgcagcgcgggggtcagagagcgaccccaacagggtagacgatcagaaaggaccccacagagatggacatgagggtccacaactgccaaaaacaaatgaggcacagccagcatacccctcagcagaactgcactgtttgcacagtccacacacactgagccagctctgcccaggccaagggacctgcctgtgaagaacccttactctcctggagtctcgctctgtcacccaggctggagtgcagtggcatgatctcagctcactacagcctccacctcccaggttcaagcgatcctcctgcctcaggcctcctgagtagctggaattacaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccag

SEQ ID NO: 201154 - DNA, 1934 bp, Homo sapiens
  Payload ID: 19706
  Gene Name: zinc finger and SCAN domain containing 18
  Uniprot ID: Q8TBC5
  ENST ID: ENST00000600404
  CDS Start-End: 31-1731
gaatatcgcatccgggaactctgcgcgcccatgcggagagtcggagggcgagctgacgaggacgctacggcggcgggaagtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccct

SEQ ID NO: 201155 - DNA, 155 bp, Homo sapiens
  Payload ID: 19706
  Gene Name: zinc finger and SCAN domain containing 18
  ENST ID: ENST00000600522
  CDS Start-End: 1-155
tggaacagaggagggtcagagaagcaaagaccgaagaggacggccctgccaacaccgagcagggtatcagctttcccagcctgacgctgcctccaggctggacactgaggaactccggttggtggaaagagatccacaaggaagcagcctcccag

SEQ ID NO: 201156 - DNA, 1768 bp, Homo sapiens
  Payload ID: 19706
  Gene Name: zinc finger and SCAN domain containing 18
  ENST ID: ENST00000595944
  CDS Start-End: 32-151
ggaatatcgcatccgggaactctgcgcgcccatgcggagagtcggagggcgagctgacgaggacgctacggcggcgggaacctgggaaacaaaagtcaaatggaagcatcaacttgggatggtgttgggaaggaactatccaatttggtgaaaataaaaaggttcatcagggatgattcctgttttatctgcattaggagaggtctgggaatgtgaggaccaggtagaaatgctccatagaaatccagaggtgcatttgaggcaaacagcatccacacacaaggacccagagcatctatgaggggctgtggtcaccatgaccattgtggtcatctgctcagtcctagcttcatgtcaaagaggtcctcaaacaacaggtttctgtgaacatgactcaaaggttaaacattttagttacatacataattgtcagaaaggctctaacggtcaaattcttgaggaaaatgatgactgtagagcagccatcagccagggtggacaacctagccaccttgatgaagatctaacaaggagatgagccttcaaaatgtaacgaaggtggtaactccttcagcctttctacacaccttagtgaacaacatgtaattgccagagaaaggaacaacacaaaggagaaggacacgaggaggtgtttgatagggacacatgtccttatgaacacaatggaagtatctctggaaatgaatacaatgacagtgaatgtggactgtccgttagaccgaaatctcatttcatcagtcaccagaggactcatactggagagagcccttatacctgtaatgactgtggaaaatccctctctaagaattacaacctgattgtacatcaaaaaatccacacaggagagaaatcctataaatgcaagaagtgggaaagccttcagtgctggctccacctttaccaagcatgagaaaacccacataggaaagaagccctgtgaaaggaattggtatgggaagaccttcagctgccactcttcccttgttttgcatttcagaagtcatactgtggaaaaactattcgaatgtaatgaatgtgaaaaatccttttctgatgtctccaaccttattgtccatctgagaattcacatgtgaggggagccctatgtatgtactgggtgtagaaaggccttcattgatcacacataacttattaaacatgggagaattcacattggaaagagaccctatatgtgtatggagtgtgaaaaattctccaaccacaacagtcagctcttttgcatcaaaaaaatcattctggaaagaaatctcatgagttaaacaatgtgaaaaaatctttcactgagattatgtacctcatcaggcacaagaggattcatactggtgagaaggtctgtggctgtaaccagtgtcaaacttttcaggaacatcgcgggcctcatctggcaccagaggactcatactggtgagaagccctacgagtgtaatcggtgtggcaaagccttcagggacagctcctgtctgaccaagcacaagaaggtacatgctcaggcgaccttgtgccagtgtgtctagtgtgggaaagttttcccaagtatctgtgctctcgctagaaaccagagttgacacattggactgagacctatggggattcagtgagcatctgtggcagtgactgatctgattttctttgcctcctctttgtcagagacttcatgttgaagagtttatgttgtttgaaagtaacaaatatgtttttccatctataaatggaagaaaaaatcctg

SEQ ID NO: 201157 - DNA, 761 bp, Homo sapiens
  Payload ID: 19706
  Gene Name: zinc finger and SCAN domain containing 18
  ENST ID: ENST00000600845
  CDS Start-End: 209-761
tgggaccggcctggggtagctgcgcagcaggtgggtcggtcccggggatgcagcgcgggggtcagagagcgaccccaacagggtagacggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacac

SEQ ID NO: 201158 - DNA, 946 bp, Homo sapiens
  Payload ID: 19706
  Gene Name: zinc finger and SCAN domain containing 18
  ENST ID: ENST00000600897
  CDS Start-End: 391-946
ctccgggcggctgggaccggcctggggtagctgcgcagcaggtgggtcggtcccggggatgcagcgcgggggtcagagagcgaccccaacagggtagacgatcagaaaggaccccacagagatggacatgagggtccacaactgccaaaaacaaatgaggcacagccagcatacccctcagcagaactgcactgtttgcacagtccacacacactgagccagctctgcccaggccaagggacctgcctgtgaagaacccttactctcctgggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacacgtg

SEQ ID NO: 201159 - DNA, 342 bp, Homo sapiens
  Payload ID: 19706
  Gene Name: zinc finger and SCAN domain containing 18
  ENST ID: ENST00000595721
  CDS Start-End: 2-342
catgcggagagtcggagggcgagctgacgaggacgctacggcggcgggaagtgagttccgtcctctcgcggcctctcgggtctgtttcctccgttcccgcccaccggtcgcggagccaaggcctagtgagggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagca

SEQ ID NO: 201160 - DNA, 2390 bp, Homo sapiens
  Payload ID: 19707
  Gene Name: zinc finger and SCAN domain containing 2
  ENST ID: ENST00000327179
  CDS Start-End: 195-2036
ggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacaattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccaca

SEQ ID NO: 201161 - DNA, 993 bp, Homo sapiens
  Payload ID: 19707
  Gene Name: zinc finger and SCAN domain containing 2
  Uniprot ID: Q7Z7L9
  ENST ID: ENST00000334141
  CDS Start-End: 227-679
ccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgctgtagctgtcgttgcttcccttccggtggaggtgaccagtttgtaatgaacttctggatctccagtcagatactatggaggagagagtgatggagggctgaggagaggcctcaggttgttatttggttggggaggcacagagcagaggttcaggtctcagcaggtgtcagaggtgattacagcccttcccatccaccttgcagcaggggctttgtgcctttcatctttaactgggcacctgagatgggaaccaatggggaccatcccagacacatgggtttgtctgtccctgacttctgcctctgagattgtctttgttggtctttgtttaataaacgccccgaccttcctcatgattgc

SEQ ID NO: 201162 - DNA, 3231 bp, Homo sapiens
  Payload ID: 19707
  Gene Name: zinc finger and SCAN domain containing 2
  ENST ID: ENST00000358472
  CDS Start-End: 161-1555
attgttctcggtgccccacgggcttgagccggggtgaatctggaggggccgggccgagcccgggggcgctttcgcacgcgaagcaaccgctagagcaggacctggtctcccgagagattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacggagtctcactctgtcacccaggctggagtgcagtggtgccatctcagctcactgcaagctccgcctcccgggttcacgccattctcctgcctcagcctcccgagtagctgggactacaggtgcccaccaccacacccagctaatttctttttttgtatttttagtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctt

SEQ ID NO: 201163 - DNA, 906 bp, Homo sapiens
  Payload ID: 19707
  Gene Name: zinc finger and SCAN domain containing 2
  Uniprot ID: Q7Z7L9
  ENST ID: ENST00000379358
  CDS Start-End: 195-635
ggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgaaacagcttcctgcgtacatggctgccctgtgtgattccagttgcagcctcacctcctttgcctctctgaaccaaagaagccagccctgcttaccccagttcccaaacacaggaagtgattttctgcctgagctttctgagttctgttccctcccaccccagggctctccatgcttattcattgcatttccttcctcattgcttttacccagtctgctgttttgggaagccctgacatgtattttggtgcctacatattttatcttctgatctcactgaaaataaaattggattttacttgttttc

SEQ ID NO: 201164 - DNA, 3813 bp, Homo sapiens
  Payload ID: 19707
  Gene Name: zinc finger and SCAN domain containing 2
  Uniprot ID: Q7Z7L9
  ENST ID: ENST00000448803
  CDS Start-End: 293-2137
gggcctctcccgtccattgttctcggtgccccacgggcttgagccggggtgaatctggaggggccgggccgagcccgggggcgctttcgcacgcgaagcaaccgctagagcaggacctggtctcccgagaggtgagccggagaggcaggcctggagccacgcggaccccgggcagtagcccgagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacggagtctcactctgtcacccaggctggagtgcagtggtgccatctcagctcactgcaagctccgcctcccgggttcacgccattctcctgcctcagcctcccgagtagctgggactacaggtgcccaccaccacacccagctaatttctttttttgtatttttagtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctt

SEQ ID NO: 201165 - DNA, 581 bp, Homo sapiens
  Payload ID: 19707
  Gene Name: zinc finger and SCAN domain containing 2
  ENST ID: ENST00000502939
  CDS Start-End: 499-581
gttctcggtgccccacgggcttgagccggggtgaatctggaggggccgggccgagcccgggggcgctttcgcacgcgaagcaaccgctagagcaggacctggtctcccgagagacggagttttgcttttgttgcccaggctggagtgcaatggcctgatctccgctcaccgcatcctctgcctcccgggttcaagcgattctcctgcctcagcctccggagtagctgggattacgggcatgcgccaccacgcctggctaattttgtttttagtagagacgaggtttctccgtgttggtcaggctggtctcgatcttccgacctcaggtgatccgcccgcctcaacctgccaaagtgctaggattacaggtctgagccaccgcgcccggctcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggagga

SEQ ID NO: 201166 - DNA, 1109 bp, Homo sapiens
  Payload ID: 19707
  Gene Name: zinc finger and SCAN domain containing 2
  ENST ID: ENST00000538076
  CDS Start-End: 28-744
gcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtcaagatggaggggcttctccagttctgagtcacccacgtgaaggtaaagaccctttctatttccagaaagtgtcaggagcacagaaacttgaggaagtacagcctggagccagtgtcccagtgtcctttccattgtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggc

SEQ ID NO: 201167 - DNA, 578 bp, Homo sapiens
  Payload ID: 19707
  Gene Name: zinc finger and SCAN domain containing 2
  ENST ID: ENST00000442073
  CDS Start-End: 481-578
gtccattgttctcggtgccccacgggcttgagccggggtgaatctggaggggccgggccgagcccgggggcgctttcgcacgcgaagcaaccgctagagcaggacctggtctcccgagaggctggagtgcaatggcctgatctccgctcaccgcatcctctgcctcccgggttcaagcgattctcctgcctcagcctccggagtagctgggattacgggcatgcgccaccacgcctggctaattttgtttttagtagagacgaggtttctccgtgttggtcaggctggtctcgatcttccgacctcaggtgatccgcccgcctcaacctgccaaagtgctaggattacaggtctgagccaccgcgcccggctcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccat

SEQ ID NO: 201168 - DNA, 910 bp, Homo sapiens
  Payload ID: 19707
  Gene Name: zinc finger and SCAN domain containing 2
  ENST ID: ENST00000485222
  CDS Start-End: 28-630
gcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccagaaagtgtcaggagcacagaaacttgaggaagtacagcctggagccagtgtcccagtgtcctttccattggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattcttt

SEQ ID NO: 201169 - DNA, 965 bp, Homo sapiens
  Payload ID: 19707
  Gene Name: zinc finger and SCAN domain containing 2
  ENST ID: ENST00000541040
  CDS Start-End: 28-660
gcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccagtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacac

SEQ ID NO: 201170 - DNA, 2914 bp, Homo sapiens
  Payload ID: 19707
  Gene Name: zinc finger and SCAN domain containing 2
  Uniprot ID: Q7Z7L9
  ENST ID: ENST00000540894
  CDS Start-End: 28-1872
gcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattgtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggc

SEQ ID NO: 201171 - DNA, 460 bp, Homo sapiens
  Payload ID: 19707
  Gene Name: zinc finger and SCAN domain containing 2
  ENST ID: ENST00000546275
  CDS Start-End: 300-460
ctctcccgtccattgttctcggtgccccacgggcttgagccggggtgaatctggaggggccgggccgagcccgggggcgctttcgcacgcgaagcaaccgctagagcaggacctggtctcccgagaggtgatccgcccgcctcaacctgccaaagtgctaggattacaggtctgagccaccgcgcccggctcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctga

SEQ ID NO: 201172 - DNA, 2242 bp, Homo sapiens
  Payload ID: 19707
  Gene Name: zinc finger and SCAN domain containing 2
  Uniprot ID: Q7Z7L9
  ENST ID: ENST00000546148
  CDS Start-End: 230-2074
cgtccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctg

SEQ ID NO: 201173 - DNA, 579 bp, Homo sapiens
  Payload ID: 19707
  Gene Name: zinc finger and SCAN domain containing 2
  ENST ID: ENST00000540936
  CDS Start-End: 259-579
aatgagcgcggcggtgggcgggcctctcccgtccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagagattttgagatacagagtgaaaatggggagaactgtaatcaagacatgt

SEQ ID NO: 201174 - DNA, 4316 bp, Homo sapiens
  Payload ID: 19708
  Gene Name: zinc finger and SCAN domain containing 20
  Uniprot ID: P17040
  ENST ID: ENST00000361328
  CDS Start-End: 154-3285
gagcccgggagcacttccgccctgttgtgaagtgggtgtctcgagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtgctgtcctcactccccgagtccctactctcccaaagatggggagcgttggagattgggaggtgacagctgagtcccaggaagccctgggccctggcaaacatgctgagaaggagctctgtaaagaccccccaggagacgactgtgggaacagcgtgtgcctgggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcagagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagagataaactttccaatttttaagcttggtgtgtacccagggaagttatcttggtataaaccaggtaatttggaagtgaattacaaatactaaggatccagatttgaaggcacttttaagtgtaatttgtttttcttctgtaaagacccacacagaatcctgactgtccttgtatttgctatcatgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctccccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatccagaattggtgaagtgatttgagcaaggatgagctattatcaaaatacttgatgtgagtttccatcttcgcaataatatgggtgagagatataggtgggttgagattgggaaaaata

SEQ ID NO: 201175 - DNA, 2367 bp, Homo sapiens
  Payload ID: 19708
  Gene Name: zinc finger and SCAN domain containing 20
  Uniprot ID: P17040
  ENST ID: ENST00000373413
  CDS Start-End: 152-1453
gggagcacttccgccctgttgtgaagtgggtgtctcggtggagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattggtaagaacatgggggtttagtcagattcagatttccaaccctcctaccagctagactgctattccctgaggtcagggcacaggctgcaagtctggattgaagccactagagtgaagagctacattccttaggtcatcctcaaactccaactttcttttcccatgaccaagtctctttgcaaaagtcttcttagttatagaagcaaacatttttaaagccttaaggggcctcaaagagtgaatccagtatttccaaaagtgtgtcactggtagtatgggatgatcatcgacgttacatgaatgaactttaaattcttgtatttatatatttctcttaatttgtatgagtgcatcaacctgtgatttcacagataacaaagttaggtaaagagtgatggcgagtgaaatattgaacagataatggcagaaatcccgacagtgtagacttgaataatcaatgtctgggaaacatccaatcattgtaaaggtgcaaacatggaagtccatgagatgaggcgtcttatagacgcacaggtaggagcagagcccggatcagagcctgtggctcctgcctgctggtttcacatggttttccctccaccatgttgccttcctgggctacatcactttcctgcagaggagctgagactagaccacctccttttcattcccctgcaaaggaggaaagtgtgtcctcatttggcctttcttgcaggactatttgaaactcatttatgcctctaatctttaggaattctcagctttcatgttttgttaaaaggagaatttatggccaggtgcggtggctcacgcctgtaatcccaacactttgggaggctgaggtgggcagatcacgaggtcaggagatcaagactatcctggccaacatggtgaaaccctgtctctactaaaaaaaatacaaaaattagctgggt

SEQ ID NO: 201176 - DNA, 2005 bp, Homo sapiens
  Payload ID: 19709
  Gene Name: zinc finger and SCAN domain containing 21
  Uniprot ID: Q9Y5A6
  ENST ID: ENST00000292450
  CDS Start-End: 165-1586
acttccgggtgcgcggtcccgaggtacgcggtgcggtctcccggtacccggagcggctctgattcatggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatctt

SEQ ID NO: 201177 - DNA, 1904 bp, Homo sapiens
  Payload ID: 19709
  Gene Name: zinc finger and SCAN domain containing 21
  ENST ID: ENST00000456748
  CDS Start-End: 165-1517
acttccgggtgcgcggtcccgaggtacgcggtgcggtctcccggtacccggagcggctctgattcatggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttgt

SEQ ID NO: 201178 - DNA, 820 bp, Homo sapiens
  Payload ID: 19709
  Gene Name: zinc finger and SCAN domain containing 21
  ENST ID: ENST00000438937
  CDS Start-End: 278-820
gaggtacgcggtgcggtctcccggtacccggagcggctctgattcatgtagagacggggtttcaccgtgttagccagaatggtctcgatctcctgacctcgtgatctgcccgcctcgggcctcccaaagtgctggaattacaggtgtgagccacggcgccgggccccctagggattttcaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaa

SEQ ID NO: 201179 - DNA, 1870 bp, Homo sapiens
  Payload ID: 19709
  Gene Name: zinc finger and SCAN domain containing 21
  ENST ID: ENST00000543588
  CDS Start-End: 140-1450
acgcggtgcggtctcccggtacccggagcggctctgattcatggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttg

SEQ ID NO: 201180 - DNA, 4629 bp, Homo sapiens
  Payload ID: 19710
  Gene Name: zinc finger and SCAN domain containing 22
  Uniprot ID: P10073
  ENST ID: ENST00000329665
  CDS Start-End: 148-1623
gaggtgtgctgggagctgtggtccgggtcggcgggcgcgcaagttggctagtctctgcggccacctccggaagggtccgccggctgtgctggtgaggcccagttccaaggctccggcatcctgtgtctcactgagcactgctgcccgatggccatccccaagcactccctgagcccagtgccgtgggaagaggacagcttccttcaagtgaaggtggaggaggaagaggaagccagcctctcccagggcggagaatccagccatgaccacattgctcactctgaggctgcacgcctgcgcttccggcacttccgctatgaggaggcatctggtccacacgaggccctggcccacctccgagcgctgtgctgtcagtggctgcagcccgaggcgcactccaaggagcagatactggagctgctggtgctggagcagttcctgggtgcgctgcccccagagatccaagcctgggtgggagcccagagtcccaagagcggagaggaagccgctgtgctggtggaggatctgactcaggtgctggacaagagaggatgggatccaggagccgagcccacagaggcaagctgcaagcagagtgacctgggagagtcagagccatcaaatgtcactgagaccctcatgggaggtgtttcccttggacccgcctttgtcaaggcatgtgaacctgagggcagctcagagaggtctggactatcaggggagatctggacaaagtctgtcacccaacagatccacttcaagaaaacttcagggccttacaaggatgtccccacagaccagcgtggccgtgaatctggtgcctcgaggaacagttctagtgcgtggccaaacctcacctcccaagagaagcctccttcagaagacaaatttgatctggtggatgcttatgggacagagcctccatacacctactcagggaagaggtcctccaagtgtcgcgagtgtaggaagatgttccagagtgcttcggcgctcgaggcacaccagaagacccattctcggaagaccccatatgcctgcagcgagtgtgggaaagccttcagccggagcactcacctcgcccagcaccaggttgtccacacaggggcgaagccccatgagtgtaaggaatgtgggaaggccttcagccgagtcacccacctgactcagcaccaaaggattcatactggagagaaaccctacaaatgtggggaatgtggtaaaaccttcagccgcagcactcacctcacccagcaccagcgggtgcacacgggggagcggccctacgagtgtgacgcgtgtgggaaagccttcagccagagcacgcacctgactcaacaccagcgcatccacaccggggagaagccctacaagtgtgacgcgtgtggccgagccttcagcgactgctcagccctgatccgacatctgagaatccactctggagagaagccatatcagtgtaaggtttgtccgaaggcctttgcacagagctcctccctcattgagcaccagaggatccacacgggagagaagccttataagtgcagcgactgtgggaaggccttcagtcgtagctcagccctgatggttcacttgcggatccacatcacggtgctgcaatgaccggaagtcgcccctgggggcgtagcacagcgtcttctcggaggctcgaggtctaagagaaacgctgagttcctgaagagccacagacagggtgggtgattgatgagttgtcaaaatgataggtgcctgagggcagactcgggctgtctaggaaccactctgcatttgaggaaccctgatgagcacaaggtgattcaggccagctggagaagcttccagaagggccctgcactgctaccctctatttcccactcagggctgtcccagagagaaggcagccgaactgaggatttagactggttctgagggccagggcaaatgaaggcgcatgtctctcagaactcagcgtcccaagacgctctgggcgggccaactgtagcttgttctcatgtggttcttcttgcctgcttttctgctgcttagcccagaacggacacctgccatgcccacctctgtgccttggcacctactatttccactccagactattttgtgcctaactgcaaggctgacttttgagactgcctcttccacgatgccttttctacactctgcctctctcatggtttcctgtcgtaatcagtggtgctgcttgacacctgcccagcatgttcctgtctctccttttccttccacatcccaccagtcaccagcgctattgttttaacctaaagcttatctgtaattcacctccttttccaccactgctaccttatgtgagccctcattgcctcttgcctggattatagccggggtctccttcctgaccacttcctgcctttattctctgcccctgtatcactctccaggggactcttgatattacttagatctgactgtgtcactccaaggtggaaagctctccaacccatcttctacagcacagcttcctgaacagggtataagtatgctgagatgcaggctgctctgggccccgagcaacctctccagttatcctcatatgcatgtatgaatactgtcatttttctgtgcgtgcagtgaaaatggcctcatctcataccatggctccaccttccatacaccagccacacggaactactgtggtccctgaaggagccatacattttcccacttatgtgcctttgtacctgtgcctggaaccctcctcttctttttctttttcttttcttttctttttttttttttgagatggagtctcgctctgtcgcccaggctggagtgcagtggcgcgatctcggctcactgcaagctctgcctcccgggttcatgccattctcctgcctcagcctcccaagtagctgggactacaggcgcctgccaccacgcccagctagtttttttttttttttgtatttttagtagagatggagtttcaccatgttagccaggatggtctcgatctcctgacctcgtgatccacccgcctcggcctcccaaagtgctgggattacaggcgtgagccaccgcacctggccctcctttttcatctaaggtgtttcaaatgttgcccaaagaaacctccctgctctccgggagcagacttcagcttgccctctctgcttccagagcacctcctagatacctctcttacaactcctgccaccttgttttacttatttgctccttgtagagctgccttttccaaggataccataaactcctgagagcaggggccatgtcttactctcagtatctacaacacacaagactcagtaggccctgactgatgtctcttacatgaatgtgactggtgcccccaggaggcagtcaccgtgctgtctctgccccacattgtccttatgtatgtttacatggatgtctccccagcagcttgaaccctggagagcaagaataatctgattttcctgggggccagcacccaaataagcctggcatgcagtggcctcaataaaatgtgactgtattgagtcattttctagggccccagatcccctggtgtcatggacttagtctttgccagcattctgtccatgtgttctctggtcttctctcacaatgctgcatccctgtcccatttttagggtccctgtctatcactggatgctgcagcttctgttcattactgttagtgtatcattcttcatgcctctgtttctgtgatggtctcatcatatgtgaaccatttgacctggcgtattgtgtactagtcaccgtcaccatctctccatatgtatctccctgtatttcgggcccattccctctatgtcaagagtaaatagaggcacagagactgatgagaaacgttcataacatgaaggtaagactcagggagacagagactttgtggaagtatctctgagggagtcccagacacaggcagagagggccacatatcgtgtgccagaggctgagagactgagagggatgacaggcttaggggaaaactcagagaggagagatgcacattcctagtgaaattgcacaggcttccagcatgctggagggaacagaaaaggcatgggcctgaattcaggctgcagagcctgactcctccctgtggctacttttgggacctaagataagtgactttcctgaacctccatgacctcctcatatgtaaaccagggacaggacccaccttgtgtagtgcctgacccaaagcctggccctgcacactgtctctgactcacagcaatcatcagcacctctctttgcctcctacttgctcagtctctgtcacaagaactggatctccatccccttgatgctctgagcatcttcacccatttggtcgttgagacatatctgtccatgtctgtctaaaaggggaggagatgagggagaaaaaagggaatctactcagagcctgtgtgtgctgcccagtctaccaaataatttatatacatctcagtcctcacacaaccatccctgttttatagaggaggaagtggcttagagaatgtaactgaccaaagtcacactgccaggaactggaagcactaggatttgacagcatatccaaatatgtcagcaatttcaataaacatgactgtactcaacaaa

SEQ ID NO: 201181 - DNA, 3126 bp, Homo sapiens
  Payload ID: 19711
  Gene Name: zinc finger and SCAN domain containing 23
  Uniprot ID: Q3MJ62
  ENST ID: ENST00000289788
  CDS Start-End: 147-1316
ctgcggttgtcaaggattcagagcagatgtgatctgcgctaggtggcatctcctctcacggatgcctcgatctcggggtttccagaagaaaagatcaagggagaattatcaagaatagattatttttctgaatagttaaacctttgatggccataaccttgacccttcagactgcagagatgcaggaaggacttctggcagtgaaggtaaaggaggaagaggaggaacattcctgtgggccagaatcaggcctgtcaagaaataaccctcataccagagagatctttcgtagacgcttcaggcagttctgctatcaggagtcccctgggccccgggaggctcttcaaagactccaggagctctgccatcagtggctgagaccagagatgcacaccaaggagcagatcctagagctgctggtgctggagcagttcctgactatcctgcctgaggagctccaggcctgggtcagacagcaccgtcctgtgagtggagaggaggcagtgactgtgctggaggatttggagagagagctggatgacccaggagagcaggtcctgagccatgctcatgaacaggaagagtttgtaaaggagaaggcaactccaggagcagctcaggagtcatcaaatgaccaattccaaaccttggaagagcaacttgggtataatttgcgagaggtgtgcccagttcaagagattgatggcaaggctgggacttggaatgtggagttagccccaaagagggagatttctcaggaagtgaaatctcttatacaagttcttggaaaacagaatggtaatattactcagattcctgagtatggagatacctgtgaccgtgagggcagattggaaaagcaaagggtgagctcttcagtggagagaccctatatctgtagtgaatgtggaaaaagcttcacccagaattccatccttatcgagcaccagagaacacacacaggtgagaagccttatgaatgtgatgagtgtgggcgggccttcagccagaggtcaggcctattccagcaccagagactccacactggggagaagcgctaccagtgcagtgtttgtggcaaagccttcagccagaatgccgggcttttccatcacctcagaattcacactggggagaagccttaccagtgcaatcagtgcaataagagttttagtcgacgttcagtcctcattaagcatcagagaattcacactggagagagaccttatgaatgtgaagaatgtggcaagaacttcatttaccattgcaacctaatccagcatcggaaagtccacccagtggctgaatcaagctagctccttggaacaggtaggggataatatttcttactttgtccctgctgtgtcctctagcatagaaaagttcaagggaaagccagtaaaaattcccttacttttatgcagagagaagcataatatcttaaatacatctgccgagttctctgatcagtgacatccacagctttgcaatactgaatgttgcctcttgtgttgatttcatcatgtatgctgtagacctagtttcacacacatctgtgcaagaagttttctatttcaggaaaacttcttcatcctagtttttaaaaactttttttaaaagtttaaaatagttatatgtaggctgagtacaaaataatctcaaatgcagttcaccgagtatttaaaaattaacttaaaaataattgtaataaaattcataatataggtttcctgacttctttccattcacataaaatatgataatttgttttgtaacctacaaaaaggggcagatgaatcctcctatataaatgtagatttatagtaagttagatttctatagattttttagttagcctttaggaaccaaggaactgaagcagccatatgttattagcagctcagtggctcctcataacaaatattgctcatgattttaaatttacgcagaggctaagaaacttagctaaaaatctgatatctcacctcagatttcttattggaaaatacaggcctctttgtatttttcccgtaacatataatgagcatttttttgtttttgcctttttctcctttattcaatattttgtatggaaaatttgaaacatattcaagattgaagagaagagtatgatcactctttcatgttgattgtttttataacctccacattttctcagcatttactattgattaccaccaagatcataaataaaaaaatttatttcccttaacattgacttagtaactctttacaaagctttacacaaggtccaggagacaaagaaatggaaaacctatggtgaaaacaatctggtttggaatacacccaaatacccaatacatagcaagtaactttagaataacagaatcactctaagggaccttagagatcacttctgcttgctcttatttgacagataagagaaaaggaagttctgggaagtaactaagatcatacagccagttaaaagcagagctggaactagaaccctgtctcctacttcctagtgtaacattctattaagccactggaggcattatatcaccaaataaaaattacaagtatatggaatttataggatttataagtcactgaagttgctcaacaaacccacccatttatatgtttcaataaagcacaactcctctatttaatttacagtggagtccaggaaagactcttctcatttattcctcattgaaagcattttatttttgtaattattatttttagcttttaaaatttaatttactcagtaggacttttttaaaaagataattcattcttcacctggttcaaaaatcaaaataatacaaaaaggtctactttccctttataagtagccattgtactagtttcttatgtatctttcagtgtttctttatgtaaatataggcaaatatgaatgtataatcttatttcttccattactcaggaagatggcatattatttatactcttctaataccttgctgttttcatgaaagaatataatctttagagatgtccacatcataacagaacttcttcattctttttataagtgaatagaattttatttgttcatactccatagtttaacaaactcctatagatgaaaaatctcactattttaaaatgtta

SEQ ID NO: 201182 - DNA, 1316 bp, Homo sapiens
  Payload ID: 19711
  Gene Name: zinc finger and SCAN domain containing 23
  ENST ID: ENST00000481983
  CDS Start-End: 160-600
atcattctttgggctgcggttgtcaaggattcagagcagatgtgatctgcgctaggtggcatctcctctcacggatgcctcgatctcggggtttccagaagaaaagatcaagggagaattatcaagaatagattatttttctgaatagttaaacctttgatggccataaccttgacccttcagactgcagagatgcaggaaggacttctggcagtgaaggtaaaggaggaagaggaggaacattcctgtgggccagaatcaggcctgtcaagaaataaccctcataccagagagatctttcgtagacgcttcaggcagttctgctatcaggagtcccctgggccccgggaggctcttcaaagactccaggagctctgccatcagtggctgagaccagagatgcacaccaaggagcagatcctagagctgctggtgctggagcagttcctgactatcctgcctgaggagctccaggcctgggtcagacagcaccgtcctgtgagtggagaggaggcagtgactgtgctggaggatttggagagagagctggatgacccaggagagcagatggcaaggctgggacttggaatgtggagttagccccaaagagggagatttctcaggaagtgaaatctcttatacaagttcttggaaaacagaatggtaatattactcagattcctgagtatggagatacctgtgaccgtgagggcagattggaaaagcaaagggtgagctcttcagtggagagaccctatatctgtagtgaatgtggaaaaagcttcacccagaattccatccttatcgagcaccagagaacacacacaggtgagaagccttatgaatgtgatgagtgtgggcgggccttcagccagaggtcaggcctattccagcaccagagactccacactggggagaagcgctaccagtgcagtgtttgtggcaaagccttcagccagaatgccgggcttttccatcacctcagaattcacactggggagaagccttaccagtgcaatcagtgcaataagagttttagtcgacgttcagtcctcattaagcatcagagaattcacactggagagagaccttatgaatgtgaagaatgtggcaagaacttcatttaccattgcaacctaatccagcatcggaaagtccacccagtggctgaatcaagctagctccttggaacagacacttacacttggagccctgagacccactgtaggcatctgcaaacaacagcaacaacaaagtgggatggaaagaaaaaagaacaaaatataagaacataaaaaagaatcagacagaaggta

SEQ ID NO: 201183 - DNA, 1652 bp, Homo sapiens
  Payload ID: 19712
  Gene Name: zinc finger and SCAN domain containing 25
  ENST ID: ENST00000262941
  CDS Start-End: 4-1401
gagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggct

SEQ ID NO: 201184 - DNA, 4079 bp, Homo sapiens
  Payload ID: 19712
  Gene Name: zinc finger and SCAN domain containing 25
  Uniprot ID: Q6NSZ9
  ENST ID: ENST00000334715
  CDS Start-End: 58-1692
gttctcaaaagggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatctt

SEQ ID NO: 201185 - DNA, 2823 bp, Homo sapiens
  Payload ID: 19712
  Gene Name: zinc finger and SCAN domain containing 25
  Uniprot ID: Q6NSZ9
  ENST ID: ENST00000394150
  CDS Start-End: 301-789
agctcacttccggaccgcggatagcactggcgaccctagcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggtgggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatg

SEQ ID NO: 201186 - DNA, 4349 bp, Homo sapiens
  Payload ID: 19712
  Gene Name: zinc finger and SCAN domain containing 25
  Uniprot ID: Q6NSZ9
  ENST ID: ENST00000394152
  CDS Start-End: 328-1962
agctcacttccggaccgcggatagcactggcgaccctagcgggtgagaggcccttcagggccgcggcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatctt

SEQ ID NO: 201187 - DNA, 594 bp, Homo sapiens
  Payload ID: 19712
  Gene Name: zinc finger and SCAN domain containing 25
  ENST ID: ENST00000431485
  CDS Start-End: 385-594
ggatagcactggcgaccctagcgggtgagaggcccttcagggccgcggcgggatctccttcccctggtgctttggacttccaagtctgtcttcccagtctaggtcttccgcataatccacttggaggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtgg

SEQ ID NO: 201188 - DNA, 1030 bp, Homo sapiens
  Payload ID: 19713
  Gene Name: zinc finger and SCAN domain containing 26
  ENST ID: ENST00000611552
  CDS Start-End: 155-967
gacactcggcgatgagctaagacgctgtttcagagcgtttgggtcctctgaggccccttgaccaggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttagg

SEQ ID NO: 201189 - DNA, 2321 bp, Homo sapiens
  Payload ID: 19713
  Gene Name: zinc finger and SCAN domain containing 26
  ENST ID: ENST00000614088
  CDS Start-End: 162-1196
atgagagtgatgaagctgtggatctggtaaacagagtacaaccttctgctgcatatttttcatccattcagcgcaattttaagtagatattaaaggagtgtctctgaagatacagtccaaagaaagttctccaaaacaaggagaacagtctgaagctggggatggcaacagcattggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaatccctgcagatttattt

SEQ ID NO: 201190 - DNA, 588 bp, Homo sapiens
  Payload ID: 19713
  Gene Name: zinc finger and SCAN domain containing 26
  ENST ID: ENST00000617168
  CDS Start-End: 138-588
agagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggacccagaccagccaaagaaacaaaaaatacttg

SEQ ID NO: 201191 - DNA, 2835 bp, Homo sapiens
  Payload ID: 19713
  Gene Name: zinc finger and SCAN domain containing 26
  ENST ID: ENST00000421553
  CDS Start-End: 271-1710
gaaatgaccctcccagccgtcctcagcaggcagcacccatgttagtctccttctgcgatgcctaagcggcagcaccatcgagccaaggtcctccagcgttcctagagcggagaagaaagcgctccgaagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggtggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaatccctgcagatttattt

SEQ ID NO: 201192 - DNA, 2729 bp, Homo sapiens
  Payload ID: 19713
  Gene Name: zinc finger and SCAN domain containing 26
  ENST ID: ENST00000619937
  CDS Start-End: 162-1601
atgagagtgatgaagctgtggatctggtaaacagagtacaaccttctgctgcatatttttcatccattcagcgcaattttaagtagatattaaaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggtggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaatccctgcagatttatttaaa

SEQ ID NO: 201193 - DNA, 2362 bp, Homo sapiens
  Payload ID: 19713
  Gene Name: zinc finger and SCAN domain containing 26
  ENST ID: ENST00000316606
  CDS Start-End: 223-1257
ccttctgcgatgcctaagcggcagcaccatcgagccaaggtcctccagcgttcctagagcggagaagaaagcgctccgaagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaac

SEQ ID NO: 201194 - DNA, 1998 bp, Homo sapiens
  Payload ID: 19713
  Gene Name: zinc finger and SCAN domain containing 26
  Uniprot ID: Q16670
  ENST ID: ENST00000623276
  CDS Start-End: 128-1564
ctcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaag

SEQ ID NO: 201195 - DNA, 2831 bp, Homo sapiens
  Payload ID: 19714
  Gene Name: zinc finger and SCAN domain containing 29
  ENST ID: ENST00000396972
  CDS Start-End: 392-1342
gtattccttctgatagtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagaccatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggagcctgagcttaggtgaattctcatgatgcagatgataggactgaggaattcaggctctaaagctctggattaagtggtgctgaaatttctcttctggtggcaggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtc

SEQ ID NO: 201196 - DNA, 5595 bp, Homo sapiens
  Payload ID: 19714
  Gene Name: zinc finger and SCAN domain containing 29
  Uniprot ID: Q8IWY8
  ENST ID: ENST00000396976
  CDS Start-End: 136-2694
agtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtcttccaatagtgagattcatctactattctgtgtccagttagcttaggaaattcactttaggatttatgccactgtttgttccttgtttttcctgatctagactcaaatccccaaggcagtctaaagaatgaaaggaagatttcagtccctctctttgcctgcatctgaattgatggataacatcttttccctctcagtgcctatggtgttcccttaatataagcacagaggacaaggtaatagatcctatgaatttgataagcatccttctttactcattctgtcattcagctgcattttgacaggaaaaacccattacatttcgagaagaagttatgagactttgcccattaggtgggtctagctcttttttttttttttggagacggagttttgctcttgttgcccaggctggagtgcaatggcacgatctcagctcactgcaacctctgcttcccgggttcaagtgattctcctgcctcagcctcccaagtggctggaattacaagcatgcgccaccatgcccagctaattttatatttttagtagagatggggtttctccatgttgggcaggctggtctcaaactcccgacctcaggtgatctgcctgcctcggcctcccaaagtgctgggattacaggcatgagccactgcgccgggcttttttttttcgagatggagtctcactctgtcgtccaggctggagtgcagtggcatgatctcagctcactgcaacctctgccttctgggttcaaacaattttcctgcctcagcctcctgagtagctgggattacagccacctgccaccataccaggctaaattttgcatttttagtagagatggggtttcaccatgttggccaggctggttttgaattgacctcatgatctgcctgcctaggtctcccaaagtgctgggattacaggtgtgagccactgcacccggcccagctcttctttatacaataatggaaatgctaaaatgaatgactcttcctgctcacttaaacctgtgctcaaaatgacatatttgtcaggcaccctcttcatttaccttaaagaaggagagtttaatgtccatcttggttctgccctatgaatcatcttgtcaagaacaggtgttcttatgcagaaacaatgaaaaccttatactgaagtgtgaaccctggatttcttagtttcttctgagtcctagaagaagggttggaatagaataatacatttacaggatttaggttggttttctttctgtccagtctcatctgaatttcgtctgtctcttgtggtccagaagttccacagagcaacgcagctgcatgtggtgacaggtagagcagttaaagctgccaataggaactcgtccatattccacacacctggtatagtgttatgccctccatgggcacttacctgcaataagcagaagccactgccacattcccgtgtattgggaaaatggactactgtgtgcgaacaggccctttaccctaatggcagggaagatggattatctttggccagtggagctgccaatctagacatacacattcaactgaatacaattaaaagcagttctttaaatgcaaatataattactcatctttataatacaatagtattaactgcccatatgctcatagtatgatgagccctgtatagcacaaggtcaacaggtcctctccttgtccttacaatctaaagcagatgacactgacatggacaaacaagtgcacatgcatagttgcggcagttttagagaaatctagaaagctaggtagcaacactatgcataaatgttgtggtccaatgcattagtttgctttaacaaaaatctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaatcatgtctataaagtg

SEQ ID NO: 201197 - DNA, 1724 bp, Homo sapiens
  Payload ID: 19714
  Gene Name: zinc finger and SCAN domain containing 29
  ENST ID: ENST00000570181
  CDS Start-End: 1-993
gaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggagcctgagcttaggtgaattctcatgatgcagatgataggactgaggaattcaggctctaaagctctggattaagtggtgctgaaatttctcttctggtggcaggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggtaagattatttcactattatggtataaataacaaagggaagacaatgggacttaggaaaaatatcatctgattgagaactggcctctacacccagctttcatggattcttcttgtgaccacccatatttcttgtctattaaagcagctcactgaggggatataaa

SEQ ID NO: 201198 - DNA, 2345 bp, Homo sapiens
  Payload ID: 19714
  Gene Name: zinc finger and SCAN domain containing 29
  ENST ID: ENST00000562072
  CDS Start-End: 1-1671
atggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaa

SEQ ID NO: 201199 - DNA, 1389 bp, Homo sapiens
  Payload ID: 19714
  Gene Name: zinc finger and SCAN domain containing 29
  ENST ID: ENST00000568898
  CDS Start-End: 1-1389
atggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaa

SEQ ID NO: 201200 - DNA, 2834 bp, Homo sapiens
  Payload ID: 19714
  Gene Name: zinc finger and SCAN domain containing 29
  ENST ID: ENST00000566849
  CDS Start-End: 150-749
gtattccttctgatagtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggagcctgagcttaggtgaattctcatgatgcagatgataggactgaggaattcaggctctaaagctctggattaagtggtgctgaaatttctcttctggtggcaggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtc

SEQ ID NO: 201201 - DNA, 643 bp, Homo sapiens
  Payload ID: 19714
  Gene Name: zinc finger and SCAN domain containing 29
  ENST ID: ENST00000561661
  CDS Start-End: 581-643
gtacttgggaggctggagagccggggccggggccggggccggggccggggtcagggtcggaccccgagtgggtgaggctggcccggaggcaaggatgcgagggggttgaggggcagctcgagagggagacgctcccaggggtgggctggagggcgccctcagggcgccttagccgggtcagaggcctctggagggaccgcacgacggctccgggttacccggccggagggagcggagacaaaagaggccagaatcccgcagccgctgctccttgggctgagagctctgcgtccgcgaaccggcagcacctggagcctctggccgacacccgagcccgtcctcaggaagcccgttactactgctcctcggattccgtctctcctgcccaatgtgactctccccaagcccccatggtcctcgctttggagccaaaaccagcttctctccttgcgcgaggttttccgacaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttc

SEQ ID NO: 201202 - DNA, 4097 bp, Homo sapiens
  Payload ID: 19715
  Gene Name: zinc finger and SCAN domain containing 30
  Uniprot ID: Q86W11
  ENST ID: ENST00000333206
  CDS Start-End: 229-1713
tgtccctagcagtgccttagccagggacctgcttggccagcgacagatcctttgctgctctgtctgccggttcttgaggtgaatgtcggaatccattatctttcgggaaagctctctggggcagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagtttt

SEQ ID NO: 201203 - DNA, 4323 bp, Homo sapiens
  Payload ID: 19715
  Gene Name: zinc finger and SCAN domain containing 30
  Uniprot ID: Q86W11
  ENST ID: ENST00000420878
  CDS Start-End: 457-1941
attaacccccgaaccgccgcgagctgtccctagcagtgccttagccagggacctgcttggccagcgacagatcctttgctgctctgtctgccggttcttgaggtgaatgtcggaatccattatctttcgggaaagctctctggggcaggcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagtt

SEQ ID NO: 201204 - DNA, 3368 bp, Homo sapiens
  Payload ID: 19715
  Gene Name: zinc finger and SCAN domain containing 30
  ENST ID: ENST00000589178
  CDS Start-End: 218-883
gtgccttagccagggacctgcttggccagcgacagatcctttgctgctctgtctgccggttcttgaggtgaatgtcggaatccattatctttcgggaaagctctctggggcagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggggtctcactctatcacccaggttggagtgcagtggtgcaaccacagctcactgcagcagccttgaacccctgggttaaagtgatcctcctgcctcagcctccagagtagctaggactacagttgtacaccaccatgcctggctaaatatccataatattcaaagctcagtattctgttatttaattttggcttcattggcaagacagtccctaagatggagatgaatacattttcagtaatagaaaccacataatcatttgaacagggaaagtttaatgttaagaattattaactactaagtgttataacaaaaagtgaaactcaaaagaatacagcaataacagatatagagtgtctctagggctgaggcagaacatcaaaggtaagaacaaatttgcaggagggtgccacaacttcccctttcctgccaggtcttagatccaggccttgttggagagggcacagccacagcccactggatggagatgccactgcagtgctgagctggcagaactcactgaggagccacactctggggtgctagaagctccccatggggagctgacctggtacagaacttgctgggaagctacccatagggatggggcctttggaactcattgggatgtgcactgctgggtgtcccatgtgctacagaaacaaacacaaagaacatgccagaaccaggaagaaaagccctttcttccagttcctctgcaaccccctctattgataaagctcacagcatgccagctggcaaatagtccagtatcacagacagggcaatgaagcgtagatttgaaactgaggcaataaattgatagctgtcacagatgccagggattagaactgaaaggactttgattatgttattggcaaaatcatccttatgggcagcagatatatcaggtataccagcttgttctcattaatcttttgttaaatctgactacccttctgattttgtcttcaccaagcaatcttattaacttcctatgaagcttagctgtaataagaaaattgcatttgttcagtctggtccatgtgatggttacattactcattaattctcattctgtttttattactgagtttcacgggcttagttattaagagtctaccccaagagataaatctattttttgtatgatgataaaattaggtatatgaggacctaagcccaaaggccagaccctggacctcggcagttcaccaaaggaatccataccatccatccactgaattcttctgggaaactgcttcccaaccttccccaggcatcataccctgatactaccattagccaagcaggccctcttaagtatcttctgcaccaagcaggtgctacattaaaacgggttttgaaaattcatctcaaggaaatcaagctgtctctatttgcagataatatgatcccatgtctagaaaaccctatcgtctcagccccaaagcttcttaagccaagaagcaactacagcaaagtctcaggatacaaaattaatgtgcaaaaatcataagcattcctatatacagagattcctatatctctgtgtctgtactgcacacctgaacaacaataagacaaccagagagccaaacatgattaactcccattcacaattgctacaaagagaataaaatacctaggaatacagctaacaagggaggtgaagggcctcttcaaggagaactacaaaccactgctcaaggaaatcagagaggacacaaacaaatggagaaacattccatgcttatggataggaagaattaatatcatgaaaatggccatactgcccaaagtaatttatagattcagtgttattcccattaaactaccattgacattcttcacagaattagaaaaaaatactttaaaattcatatggtacaaaaaaaagagcccttatagccaagacaatcctaagcaaaaagaacaaagctggaggcatcatgccacctgccttcaatctgtactacaaggctactataacccaaacagcatggtactggtacaaaaacagacacatagaccaatggaacagaatagagatctgagaaataagactgcacatctacaaccacttgatatttgacaaacctgacacaaacaagcaatggggaaaggattacctatttgataaatggtgctgggaaaactggctagccatatgcagaaaactgaaactggatccctcctttacaccttgtacaaaaataaactcaacatggactaaagacttaaatgtaaaacccaaaactataaaatccctagtaaaaaaatctaggtaataccattcaggacataggcatgggcaaagatttcatgatgaaaatgtcaaaagcaattgcaatagaagcaaaaattgacaaatgggacgtaattaaagagcttttgcacagcaaaagaacctattataagagtgaacagacaatgtacagaatgggagaaaatttttgcaatctatccatctgacaaaggtctaatatccaggatctacaagaaacttaaacaaatttacaagaaaaaaacaaccccattaaaaagtgggcaaaggacatgaacagagacctcaaaagaagacatttatgcacc

SEQ ID NO: 201205 - DNA, 549 bp, Homo sapiens
  Payload ID: 19715
  Gene Name: zinc finger and SCAN domain containing 30
  ENST ID: ENST00000592211
  CDS Start-End: 407-549
aacccccgaaccgccgcgagctgtccctagcagtgccttagccagggacctgcttggccagcgacagatcctttgctgctctgtctgccggttcttgagcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccg

SEQ ID NO: 201206 - DNA, 588 bp, Homo sapiens
  Payload ID: 19715
  Gene Name: zinc finger and SCAN domain containing 30
  ENST ID: ENST00000592598
  CDS Start-End: 382-588
gcaggacccgtccccgccccagcccttccgcagctcctaggactgtcgtcttcgcagtcagcacgtccgcgcagcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctg

SEQ ID NO: 201207 - DNA, 731 bp, Homo sapiens
  Payload ID: 19715
  Gene Name: zinc finger and SCAN domain containing 30
  ENST ID: ENST00000592278
  CDS Start-End: 195-632
aaccgccgcgagctgtccctagcagtgccttagccagggacctgcttggccagcgacagatcctttgctgctctgtctgccggttcttgaggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggagttttctgcttgtgtatcctcagaatgatagtgctggtacttgattactcctaggacacaactcatggccaagaaatgttctggcaggaaatgacatccacaggagcactgaagtctctgtctctga

SEQ ID NO: 201208 - DNA, 464 bp, Homo sapiens
  Payload ID: 19715
  Gene Name: zinc finger and SCAN domain containing 30
  ENST ID: ENST00000588448
  CDS Start-End: 1-276
gagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattc

SEQ ID NO: 201209 - DNA, 510 bp, Homo sapiens
  Payload ID: 19715
  Gene Name: zinc finger and SCAN domain containing 30
  ENST ID: ENST00000601405
  CDS Start-End: 33-188
tgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattc

SEQ ID NO: 201210 - DNA, 3439 bp, Homo sapiens
  Payload ID: 19715
  Gene Name: zinc finger and SCAN domain containing 30
  ENST ID: ENST00000610712
  CDS Start-End: 124-1047
agggctgccgagaattaacccccgaaccgccgcgagctgtccctagcagtgccttagccagggacctgcttggccagcgacagatcctttgctgctctgtctgccggttcttgagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagttt

SEQ ID NO: 201211 - DNA, 2619 bp, Homo sapiens
  Payload ID: 19716
  Gene Name: zinc finger and SCAN domain containing 31
  Uniprot ID: Q96LW9
  ENST ID: ENST00000344279
  CDS Start-End: 180-1400
acgcatttccggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaa

SEQ ID NO: 201212 - DNA, 3176 bp, Homo sapiens
  Payload ID: 19716
  Gene Name: zinc finger and SCAN domain containing 31
  Uniprot ID: Q96LW9
  ENST ID: ENST00000396838
  CDS Start-End: 527-1747
cagagagagagagaaaaactgctgaccctgtaagagagaactggccatcttgcagacagacagagccccgagtgttctttcaactacctgccacccatccaacaactcccctcggacctcagtatgggctggaacctgacacttggcatgacagtgaccccaggcatccaaaccatgacagttccatcagctctccaaatgagagacagagtctcactatgtcgcccaggcttgtcttgaactcctggactcaagagatcctcccatctcggcctctcaaagtgttgggattacaggcgtgagctattacacctgacttaagtctccattttcatatctatactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccctaaa

SEQ ID NO: 201213 - DNA, 799 bp, Homo sapiens
  Payload ID: 19716
  Gene Name: zinc finger and SCAN domain containing 31
  ENST ID: ENST00000453745
  CDS Start-End: 149-799
gcctggcttcagccagtgggctcagaacggctgacgcatttccggcctttgcggttgatcggtcattggggtgctgcagccccgccacctgttccgtagcttgccggtgccccgaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacaga

SEQ ID NO: 201214 - DNA, 3551 bp, Homo sapiens
  Payload ID: 19716
  Gene Name: zinc finger and SCAN domain containing 31
  Uniprot ID: Q96LW9
  ENST ID: ENST00000414429
  CDS Start-End: 905-2125
attgctgggcaactaggtcccgccggagcgttccagctcaaagattacctgctgcagtcaggcagaaatgtaaagtctttcctgtttgattgggaactgacccaggtgccaggcttggggggacaccggacaaccaaaggcaatatgtggactcggcaagccactggtccctaaacctgaataagtttccgggcagagctgcatttattgacggttatgaaagctgatttagaagcagcaacgcagcctcttgcctggaattgggatgatgcggctgaaaccaccttcctggcagccaaacaggctattcagcaggcacaagccctatgggtagctgatcggggcacccatttaaacttgatgtgcatgtgaccagatagttttgactggggcttatggcatcacacagagctctttagaatgccagtagacttttggtcccaactttggaagggagctgagctccagtattcctcgacagagaagcagttactaactgcatatgctgccctttagactcgtgacagcctggcaggatgggctacagtcgtcgcgcgcatgacttacccaatagcaggccccgagtgttctttcaactacctgccacccatccaacaactcccctcggacctcagtatgggctggaacctgacacttggcatgacagtgcagaccccaggcatccaaaccatgacagttccatcagctctccaaatgagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccct

SEQ ID NO: 201215 - DNA, 1005 bp, Homo sapiens
  Payload ID: 19716
  Gene Name: zinc finger and SCAN domain containing 31
  ENST ID: ENST00000435857
  CDS Start-End: 391-1005
gttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgca

SEQ ID NO: 201216 - DNA, 580 bp, Homo sapiens
  Payload ID: 19716
  Gene Name: zinc finger and SCAN domain containing 31
  ENST ID: ENST00000439628
  CDS Start-End: 529-580
acttgtgcccagagagagagagaaaaactgctgaccctgtaagagagaactggccatcttgcagacagacagaggtgagccaggaattaacaagcatgccaaggagtacagctgtaagtgtgggagcggcaggagccacagagccgtttgctgagaagggctgcggtcggaggaggcagccgagacagaggcagacagtgtgagagctgcagcagctgctgctgaataaaatcatattttacctgcctacagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaag

SEQ ID NO: 201217 - DNA, 574 bp, Homo sapiens
  Payload ID: 19716
  Gene Name: zinc finger and SCAN domain containing 31
  ENST ID: ENST00000426434
  CDS Start-End: 311-574
acttgtgcccagagagagagagaaaaactgctgaccctgtaagagagaactggccatcttgcagacagacagaggtgagccaggaattaacaagcatgccaaggagtacagctgtaagtgtgggagcggcaggagccacagagccgtttgctgagaagggctgcggtcggaggaggcagccgagacagaggcagacagtgtgagagctgcagcagctgctgctgaataaaatcatattttacctgcctacagccccgagtgttctttcaactacctgccacccatccaacaactcccctcggacctcagtatgggctggaacctgacacttggcatgacagtggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagc

SEQ ID NO: 201218 - DNA, 2562 bp, Homo sapiens
  Payload ID: 19716
  Gene Name: zinc finger and SCAN domain containing 31
  Uniprot ID: Q96LW9
  ENST ID: ENST00000446474
  CDS Start-End: 402-1145
attggggtgctgcagccccgccacctgttccgtagcttgccggtgccccgaaggtgagtcttggccccttgtcgcgacccgccaggttcccagaagatttcaggtctgtgccttggagtaggcggggagggaacgtctgcgcaggcgtgacccccgcccctacacattcactggcctgaagcccccgtggagtaggtggaggtcccgccccttatcctgaagattaaacagcctttctttgtctgagataacgcccggagttctttgtcctgcctccaagacgataaaggagcgcagacacaaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactg

SEQ ID NO: 201219 - DNA, 575 bp, Homo sapiens
  Payload ID: 19716
  Gene Name: zinc finger and SCAN domain containing 31
  ENST ID: ENST00000426756
  CDS Start-End: 256-575
aatgagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtgg

SEQ ID NO: 201220 - DNA, 571 bp, Homo sapiens
  Payload ID: 19716
  Gene Name: zinc finger and SCAN domain containing 31
  ENST ID: ENST00000414431
  CDS Start-End: 259-571
attggggtgctgcagccccgccacctgttccgtagcttgccggtgccccgaagatgtctatcaagtatttgttccctgctaggatatcagatgacaccaaatttgcatttaatcgaataaatcaggtaaacaaaacattgaagatgcgttcataattttgtggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactgggg

SEQ ID NO: 201221 - DNA, 706 bp, Homo sapiens
  Payload ID: 19716
  Gene Name: zinc finger and SCAN domain containing 31
  ENST ID: ENST00000446222
  CDS Start-End: 397-706
agagaaaaactgctgaccctgtaagagagaactggccatcttgcagacagacagagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatc

SEQ ID NO: 201222 - DNA, 583 bp, Homo sapiens
  Payload ID: 19716
  Gene Name: zinc finger and SCAN domain containing 31
  ENST ID: ENST00000439636
  CDS Start-End: 117-583
aaaaggagaagaaacttttcctgggaacctgctgactatacaaaggacaaaggcattatgtgtcaggccttgttcccttatctgaccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacataca

SEQ ID NO: 201223 - DNA, 3050 bp, Homo sapiens
  Payload ID: 19716
  Gene Name: zinc finger and SCAN domain containing 31
  Uniprot ID: Q96LW9
  ENST ID: ENST00000439158
  CDS Start-End: 401-1621
attggggtgctgcagccccgccacctgttccgtagcttgccggtgccccgaaggtgagtcttggccccttgtcgcgacccgccaggttcccagaagatttcaggtctgtgccttggagtaggcggggagggaacgtctgcgcaggcgtgacccccgcccctacacattcactggcctgaagcccccgtggagtaggtggaggtcccgccccttatcctgaagattaaacagcctttctttgtctgagataacgcccggagttctttgtcctgcctccaagacgataaaggagcgcagacacaaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccctaaa

SEQ ID NO: 201224 - DNA, 557 bp, Homo sapiens
  Payload ID: 19716
  Gene Name: zinc finger and SCAN domain containing 31
  ENST ID: ENST00000444081
  CDS Start-End: 485-557
agagccgtttgctgagaagggctgcggtcggaggaggcagccgagacagaggcagacagtgtgagagctgcagcagctgctgctgaataaaatcatattttacctgcctacagccccgagtgttctttcaactacctgccacccatccaacaactcccctcggacctcagtatgggctggaacctgacacttggcatgacagtgagacagagtctcactatgtcgcccaggcttgtcttgaactcctggactcaagagatcctcccatctcggcctctcaaagtgttgggattacaggcactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaa

SEQ ID NO: 201225 - DNA, 581 bp, Homo sapiens
  Payload ID: 19716
  Gene Name: zinc finger and SCAN domain containing 31
  ENST ID: ENST00000447021
  CDS Start-End: 139-581
gaggtcccgccccttatcctgaagattaaacagcctttctttgtctgagataacgcccggagttctttgtcctgcctccaagacgataaaggagcgcagacacaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggt

SEQ ID NO: 201226 - DNA, 584 bp, Homo sapiens
  Payload ID: 19716
  Gene Name: zinc finger and SCAN domain containing 31
  ENST ID: ENST00000434036
  CDS Start-End: 351-584
acttgtgcccagagagagagagaaaaactgctgaccctgtaagagagaactggccatcttgcagacagacagagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatc

SEQ ID NO: 201227 - DNA, 2669 bp, Homo sapiens
  Payload ID: 19716
  Gene Name: zinc finger and SCAN domain containing 31
  Uniprot ID: Q96LW9
  ENST ID: ENST00000611469
  CDS Start-End: 500-1243
gttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaagatgtctatcaagtatttgttccctgctaggatatcagatgacaccaaatttgcatttaatcgaataaatcaggtaaacaaaacattgaagatgcgttcataattttgtggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccct

SEQ ID NO: 201228 - DNA, 3027 bp, Homo sapiens
  Payload ID: 19717
  Gene Name: zinc finger and SCAN domain containing 32
  Uniprot ID: Q9NX65
  ENST ID: ENST00000304926
  CDS Start-End: 803-2260
gtaatgggcggagcgaatcgcgccgctgacttccggcccggaggctgagggagaatgtttgataggtttatattgtctttttccatcctcttcagacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcctggcttgctcctcaggctcccaggaacctgcctcaaaacacaggtctccacgaccaggagacaggtgctgtggtctggacagctgggtcccaggctagagtggtgctattttatcggtagcagcagctccagtgttgttacagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 201229 - DNA, 3173 bp, Homo sapiens
  Payload ID: 19717
  Gene Name: zinc finger and SCAN domain containing 32
  Uniprot ID: Q9NX65
  ENST ID: ENST00000396846
  CDS Start-End: 309-2402
agtccggcaattcggcttgcgggcctgcgcaggggcgtgcgtaatgggcggagcgaatcgcgccgctgacttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctccacttc

SEQ ID NO: 201230 - DNA, 3169 bp, Homo sapiens
  Payload ID: 19717
  Gene Name: zinc finger and SCAN domain containing 32
  Uniprot ID: Q9NX65
  ENST ID: ENST00000396852
  CDS Start-End: 309-2402
agtccggcaattcggcttgcgggcctgcgcaggggcgtgcgtaatgggcggagcgaatcgcgccgctgacttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 201231 - DNA, 1746 bp, Homo sapiens
  Payload ID: 19717
  Gene Name: zinc finger and SCAN domain containing 32
  Uniprot ID: Q9NX65
  ENST ID: ENST00000439568
  CDS Start-End: 167-1393
tccggcccggaggctgagggagtttgtggagtcgcgagtgctggtgtccgcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaaga

SEQ ID NO: 201232 - DNA, 1267 bp, Homo sapiens
  Payload ID: 19717
  Gene Name: zinc finger and SCAN domain containing 32
  ENST ID: ENST00000422427
  CDS Start-End: 295-942
gcgaatcgcgccgctgacttccggcccggaggctgagggagtttgtggagtcgcgagtgctggtgtccggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaaggctagagtggtgctattttatcggtagcagcagctccagtgttgttacagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggtaagactcccttggctctgatggtcaaaggatggcaaagtccactttagaggccattagcctagcagttgagtaggagctgtcactgatcctggcatcatcatcatcttgatgtgtgaccctatccaagttttggttttcatggagttaaaggttattccccttgcattttacagccctgattttgcatttgccaacctctttcaactaagttcatgtcatcttttcccatggagtttcactatgcattgtcagactgctggttaggcctccagaccaggtccatcttctccctttttctctagcatggccttgcctttcacagcctgagcctatgctggctgggtacttagcaccttgctttcttcctgtttg

SEQ ID NO: 201233 - DNA, 879 bp, Homo sapiens
  Payload ID: 19717
  Gene Name: zinc finger and SCAN domain containing 32
  ENST ID: ENST00000575350
  CDS Start-End: 321-879
gttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccaggctagagtggtgctattttatcggtagcagcagctccagtgttgttacagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtca

SEQ ID NO: 201234 - DNA, 2441 bp, Homo sapiens
  Payload ID: 19717
  Gene Name: zinc finger and SCAN domain containing 32
  ENST ID: ENST00000576500
  CDS Start-End: 239-799
ttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccacc

SEQ ID NO: 201235 - DNA, 2180 bp, Homo sapiens
  Payload ID: 19717
  Gene Name: zinc finger and SCAN domain containing 32
  ENST ID: ENST00000574940
  CDS Start-End: 189-1472
gacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggtaagactcccttggctctgatggtcaaaggatggcaaagtccactttagaggccattagcctagcagttgagtaggagctgtcactgatcctggcatcatcatcatcttgatgtgtgaccctatccaagttttggttttcatggagttaaaggttattccccttgcattttacagccctgattttgcatttgccaacctctttcaactaagttcatgtcatcttttcccatggagtttcactatgcattgtcagactgctggttaggcctccagaccaggtccatcttctccctttttctctagcatggccttgcctttcacagcctgagcctatgctggctgggtacttagcaccttgctttcttcctgtttgagctggccaagcccagggttgccttttgttattctgctgctagaagttagaacattcaagaattgagggtacacctataaacagactggcagatgatatagtgcttaatgtcttgcctcagtttgtcattgtgtcagaacatccgaaaaaagataggagaaaagttggagtttagggcataattttcctgtaataatttggagctcaaaaatattacaatgagaaaataaaaagctattaattagcaggagacttaatcacatgaagaatttcaattagatatttcttctacgtagtatagttataactttgcattccattgttttccttctctatagtccattgtatttctgtggggtttttttttttcaggttttgagttc

SEQ ID NO: 201236 - DNA, 668 bp, Homo sapiens
  Payload ID: 19717
  Gene Name: zinc finger and SCAN domain containing 32
  ENST ID: ENST00000573830
  CDS Start-End: 162-578
cccggaggctgagggagtttgtggagtcgcgagtgctggtgtccgcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggtaagactcccttggctctgatggtcaaaggatggcaaagtccactttagaggccattagcctagcagttgagtaggagctgtcactgatcctggcatcatcatcatcttgatgtgtgaccctatccaagttttggtttt

SEQ ID NO: 201237 - DNA, 1482 bp, Homo sapiens
  Payload ID: 19717
  Gene Name: zinc finger and SCAN domain containing 32
  ENST ID: ENST00000573327
  CDS Start-End: 208-1482
gtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaa

SEQ ID NO: 201238 - DNA, 841 bp, Homo sapiens
  Payload ID: 19717
  Gene Name: zinc finger and SCAN domain containing 32
  ENST ID: ENST00000573719
  CDS Start-End: 189-841
gacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcaacaggtgtgccctggggctatgaagagaccaagacgctcctggctattcttagtagttctcaattttatggaaaactccagacctgtcagcagaacagccagatctacagggccatggc

SEQ ID NO: 201239 - DNA, 906 bp, Homo sapiens
  Payload ID: 19717
  Gene Name: zinc finger and SCAN domain containing 32
  ENST ID: ENST00000571906
  CDS Start-End: 220-906
ggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagcc

SEQ ID NO: 201240 - DNA, 2788 bp, Homo sapiens
  Payload ID: 19717
  Gene Name: zinc finger and SCAN domain containing 32
  Uniprot ID: Q9NX65
  ENST ID: ENST00000618425
  CDS Start-End: 791-2017
agtccggcaattcggcttgcgggcctgcgcaggggcgtgcgtaatgggcggagcgaatcgcgccgctgacttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctccacttc

SEQ ID NO: 201241 - DNA, 2246 bp, Homo sapiens
  Payload ID: 19718
  Gene Name: zinc finger and SCAN domain containing 4
  Uniprot ID: Q8NAM6
  ENST ID: ENST00000318203
  CDS Start-End: 698-1999
ccttgtaattcataaatctctgaaaacttaaaagtttgagcaaaagtttgtcatgtttctatgagtaatttataataaaacttgatcagaatttgtgagactaacgtttgtctttatattttccttttttttttttttttttttgagacacagtctcgctctgtcgtccaggctggagtgccgtggcgtaatctcggctcactgcaacctctgcctcctggattcaaacaattcttctgcctcagcctcctgagtagctgggattacaggaccagtgatggtatagaacactgtattagagacatggagctggggctggatgaagattccatcagtaattcaatcaacagacaagtgttatccaatcacgtctttaaatcaatcactgacatggagctggggctggatgaagattccatcagtaattcaatcaacagacaagtgttatccaatcacgtctttaaatcaatcactgatcccagcccctataaaagggagcagccttaggaggcacatcagataaacccagtgtggaaagctagtcacacatcagctcagtgttcggcccgggattacccagtcaaccaaggagcttgcagttttaaagaatccaccaactgttgaaacaaatccctagagacacaaggcaagagactgaatcatcaaagtaaagtctctctgagaattattgctaagaatggctttagatctaagaaccatatttcagtgtgaaccatccgagaataatcttggatcagaaaattcagcgtttcaacaaagccaaggacctgctgttcagagagaagaagggatttctgagttctcaagaatggtgctcaattcatttcaagacagcaataattcatatgcaaggcaggaattgcaaagactttataggatctttcactcatggctgcaaccagaaaagcacagcaaggatgaaattatttctctattagtcctggagcagtttatgattggtggccactgcaatgacaaagccagtgtgaaagagaaatggaaatcaagtggcaaaaacttggagagattcatagaagacctgactgatgacagcataaatccacctgccttagtccacgtccacatgcagggacaggaagctctcttttctgaggatatgcccttaagagatgtcattgttcatctcacaaaacaagtgaatgcccaaaccacaagagaagcaaacatggggacaccctcccagacttcccaagatacttccttagaaacaggacaaggatatgaagatgaacaagatggctggaacagttcttcgaaaactactcgagtaaatgaaaatattactaatcaaggcaatcaaatagtttccctaatcatcatccaggaagagaacggtcctaggcctgaagagggaggtgtttcttctgacaacccatacaactcaaaaagagcagagctagtcactgctagatctcaggaagggtccataaatggaatcactttccaaggtgtccctatggtgatgggagcagggtgtatctctcaaccagagcagtcctcccctgagtctgcccttacccaccagagcaatgagggaaattccacatgtgaggtacatcagaaaggatcccatggagtccaaaaatcatacaaatgtgaagaatgccccaaggtctttaagtatctctgtcacttattagctcaccagagaagacacaggaatgagaggccatttgtttgtcccgagtgtcaaaaaggcttcttccagatatcagacctacgggtgcatcagataattcacacaggaaagaagcctttcacatgcagcatgtgtaaaaagtccttcagccacaaaaccaacctgcggtctcatgagagaatccacacaggagaaaagccttatacatgtcccttttgtaagacaagctaccgccagtcatccacataccaccgccatatgaggactcatgagaaaattaccctgccaagtgttccctccacaccagaagcttcctaagctgctggtctgataatgtgtataaatatgtatgcaagtatgtatattcctatagtatttatctacttaggatataagatataatctcctgattatgctttcaatttattgtcttgcttcattaaaatgtaaggctaaggagagcatggaatttgtcagttttgttcactaaagtattccaagtggttgggaaagtggaacatttccaagaaccaataaatttctgttgaataaatgaatgaatcca

SEQ ID NO: 201242 - DNA, 1979 bp, Homo sapiens
  Payload ID: 19718
  Gene Name: zinc finger and SCAN domain containing 4
  Uniprot ID: Q8NAM6
  ENST ID: ENST00000612521
  CDS Start-End: 432-1733
caggaccagtgatggtatagaacactgtattagagacatggagctggggctggatgaagattccatcagtaattcaatcaacagacaagtgttatccaatcacgtctttaaatcaatcactgacatggagctggggctggatgaagattccatcagtaattcaatcaacagacaagtgttatccaatcacgtctttaaatcaatcactgatcccagcccctataaaagggagcagccttaggaggcacatcagataaacccagtgtggaaagctagtcacacatcagctcagtgttcggcccgggattacccagtcaaccaaggagcttgcagttttaaagaatccaccaactgttgaaacaaatccctagagacacaaggcaagagactgaatcatcaaagtaaagtctctctgagaattattgctaagaatggctttagatctaagaaccatatttcagtgtgaaccatccgagaataatcttggatcagaaaattcagcgtttcaacaaagccaaggacctgctgttcagagagaagaagggatttctgagttctcaagaatggtgctcaattcatttcaagacagcaataattcatatgcaaggcaggaattgcaaagactttataggatctttcactcatggctgcaaccagaaaagcacagcaaggatgaaattatttctctattagtcctggagcagtttatgattggtggccactgcaatgacaaagccagtgtgaaagagaaatggaaatcaagtggcaaaaacttggagagattcatagaagacctgactgatgacagcataaatccacctgccttagtccacgtccacatgcagggacaggaagctctcttttctgaggatatgcccttaagagatgtcattgttcatctcacaaaacaagtgaatgcccaaaccacaagagaagcaaacatggggacaccctcccagacttcccaagatacttccttagaaacaggacaaggatatgaagatgaacaagatggctggaacagttcttcgaaaactactcgagtaaatgaaaatattactaatcaaggcaatcaaatagtttccctaatcatcatccaggaagagaacggtcctaggcctgaagagggaggtgtttcttctgacaacccatacaactcaaaaagagcagagctagtcactgctagatctcaggaagggtccataaatggaatcactttccaaggtgtccctatggtgatgggagcagggtgtatctctcaaccagagcagtcctcccctgagtctgcccttacccaccagagcaatgagggaaattccacatgtgaggtacatcagaaaggatcccatggagtccaaaaatcatacaaatgtgaagaatgccccaaggtctttaagtatctctgtcacttattagctcaccagagaagacacaggaatgagaggccatttgtttgtcccgagtgtcaaaaaggcttcttccagatatcagacctacgggtgcatcagataattcacacaggaaagaagcctttcacatgcagcatgtgtaaaaagtccttcagccacaaaaccaacctgcggtctcatgagagaatccacacaggagaaaagccttatacatgtcccttttgtaagacaagctaccgccagtcatccacataccaccgccatatgaggactcatgagaaaattaccctgccaagtgttccctccacaccagaagcttcctaagctgctggtctgataatgtgtataaatatgtatgcaagtatgtatattcctatagtatttatctacttaggatataagatataatctcctgattatgctttcaatttattgtcttgcttcattaaaatgtaaggctaaggagagcatggaatttgtcagttttgttcactaaagtattccaagtggttgggaaagtggaacatttccaagaaccaataaatttctgttgaataaatgaatgaatcc

SEQ ID NO: 201243 - DNA, 3562 bp, Homo sapiens
  Payload ID: 19719
  Gene Name: zinc finger and SCAN domain containing 5A
  Uniprot ID: Q9BUG6
  ENST ID: ENST00000391713
  CDS Start-End: 167-1657
cccagaccgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaatattgtataacggaaaactgagtttcctgattgacatggggttacccactgttttgctgtaaagtacagttgtccaaggagggtggccatataaaatacataatgcctgatgaaatttgagtttcagataaacaattttctttagtatcagcatgttctaaattatttatttatctgaaactcagcttttattgggtatcctgtagagttttcgttttcttttttctttctttctttttttttttttttgagatggcgtctccctctgtcacgcaggctgaggttcagtggcataatcaccgctcactgcagccgcgaccttccaggctcaagcaatcctcccatctaagcctcccgagcagccgagactacaggagcacgccaccaacttggctaatttttgtggtttttgtagagatggaattttgatatgttgcccaggctggtcttgaactccgaagtacaagtgatccaactgcctcggcctccttaagtgctggcattacaggcatgagccgctgtgccctgtattgtttttattagactttattataattatgatattcaaatttttgaaataattttttgtagtgatgggatttcttgttgcccaggctggtgtggggtgagccaccacgcctggctctagactttctttttcagagctgtttaggttcacagggaaattcagtggacagcacagagttcccctagactccctcctcacacaacacagcctctccctgcccagcatccccagcagagtggtgcacctgttccatcagtgaggctgcctggacatatcaccaccacccagagtccatagtgttcattagggctcgctctgggtgttgtacgtgctgtgggtttggacaaaggcctcatgagtacacaccactggagtatcctggggggtattttcactgcccccggaatcctctctgctctgcatatttatctccctgccccagatggtgtattttgtggcctaaatttggcaacctctaaattcccgatttgactcttgaactacagaggcattgggagtctctggtgactagttggtcttagtgatactaccatcccctgaaggcgtggttaatcctcaggtgggtgggccccagactcagcttctgattgagcagaccgggcatggggcctgagagtgtgcattaaaatatataattcattttagaatagctttctaaagtccatggagctccctaatgccccacatggcttcccccattgccaacatggttcattaggatggcacctttgaactgactggagcgatgaactgactggatatattgccgtgatctaaggcccataccttattgaggcctccttagtgtttacacaatgccctcctcttccttcctccccatccaagacaccacattgccttgagttgtcacgtctccctaggatcctcttggtgacaatttctcagattttacttgtttgggattacctgagaatgtacattttaggtggtgctcatgctgctggtcttgggaggacattttatggatggctgattgagctgacgggcagagtcctgcaatctgcagaggtctggaaaggtcccttcccaaataggctggattcatttattaaagactacttttgtaaga

SEQ ID NO: 201244 - DNA, 849 bp, Homo sapiens
  Payload ID: 19719
  Gene Name: zinc finger and SCAN domain containing 5A
  ENST ID: ENST00000593106
  CDS Start-End: 280-849
gccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaactgactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattcccca

SEQ ID NO: 201245 - DNA, 1542 bp, Homo sapiens
  Payload ID: 19719
  Gene Name: zinc finger and SCAN domain containing 5A
  ENST ID: ENST00000587492
  CDS Start-End: 402-1454
attctagttcagccctctgagcaagggctgggagttgcgacccccgccccggatccggaagtggtcgccgaggcctcctagcagccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaacttctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaa

SEQ ID NO: 201246 - DNA, 923 bp, Homo sapiens
  Payload ID: 19719
  Gene Name: zinc finger and SCAN domain containing 5A
  ENST ID: ENST00000592679
  CDS Start-End: 809-923
gacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggtaacgactttagcttcccttccgcccttgcggtgacgtcactggcggaggccggactggggtgggttggggagagggagggcgcatgcgcctggggcggggacgtgggaggagggggagattcgtgggaggaccgagcccggggatgggactggaggagtttccgtgaccttgcgggctgtttgtgctgagggacagctttatttaaataataatatgcgtgcaggcgccctgcatgattcctggccgcgtgctttctagtaagtgcgcagagacttttcgcaagaattgattcactcttttttccttccctcccgatttttgattggaaacccagacttcctttcacgcctgtcgccaggttaactaggtcactgtttgctctcaggagcaaccctgcctcccgcagttcgcttggtccttgattacaggggaggttccctgctcaagctctcttctcttgtctgctgccatgtgagacgtgcctttgaccttctgccatgattgtgaggcctccccagccacgtgaaactacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtgg

SEQ ID NO: 201247 - DNA, 1813 bp, Homo sapiens
  Payload ID: 19719
  Gene Name: zinc finger and SCAN domain containing 5A
  ENST ID: ENST00000592355
  CDS Start-End: 63-1550
caggccggttggagagcgcatcccagaccgagaaggtcggaggcagaagccgggaaggagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccaatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttc

SEQ ID NO: 201248 - DNA, 2450 bp, Homo sapiens
  Payload ID: 19719
  Gene Name: zinc finger and SCAN domain containing 5A
  Uniprot ID: Q9BUG6
  ENST ID: ENST00000587340
  CDS Start-End: 697-2187
aggtctccctggagcccgccgacctgaagcagcggccgcaccgcgtatgcgcccgggtggtttctgggagtaggcgaggactcgcagtgcgcatgtgcagcccccacggccccgctcccagtgaccggaatgcagaggcgtacatggctaagagacgagctacctgggacacaaagatgagaaccacaagcatgagaacatgaggataaatacactttggggaaaaagaaaacagacagaggcagcagagaaggaagacgagaagaagagaaaaagagaagtaggaagaggatgaattcatttcgcttatctggcaaatgtgtaatctgagtaatagagatggtgcaatgctgggccacagagcttgccccaggtccccaagcaaagtcagtggcactgcctggactggaagttcatccccatccattttcacgtgcggagtctcagggctcagtaaagaaccatgattgacggaggtcacacagcaactggtatgacagggacaggtttccggaattccagtgtcttaacaccaaagcctgtagtatttctcagagagaacaacaccactgctcgtgtgtgctcagaagaaagtttagtggtcgtaacatccaatacatccaacctgcagatcaatacacaaagaccctggaggaaggtggggcggtaacttgtccaaatctccaaagaaaagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttc

SEQ ID NO: 201249 - DNA, 576 bp, Homo sapiens
  Payload ID: 19719
  Gene Name: zinc finger and SCAN domain containing 5A
  ENST ID: ENST00000588955
  CDS Start-End: 323-576
gaccttgcgggctgtttgtgctgagggacagctttatttaaataataatatgcgtgcaggcgccctgcatgattcctggccgcgtgctttctagggaggttccctgctcaagctctcttctcttgtctgctgccatgtgagacgtgcctttgaccttctgccatgattgtgaggcctccccagccacgtgaaactacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctgga

SEQ ID NO: 201250 - DNA, 576 bp, Homo sapiens
  Payload ID: 19719
  Gene Name: zinc finger and SCAN domain containing 5A
  ENST ID: ENST00000588442
  CDS Start-End: 450-576
aatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggtaacgactttagcttcccttccgcccttgcggtgacgtcactggcggaggccggactggggggaggttccctgctcaagctctcttctcttgtctgctgccatgtgagacgtgcctttgaccttctgccatgattgtgaggcctccccagccacgtgaaactacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagattt

SEQ ID NO: 201251 - DNA, 589 bp, Homo sapiens
  Payload ID: 19719
  Gene Name: zinc finger and SCAN domain containing 5A
  ENST ID: ENST00000592509
  CDS Start-End: 274-589
actcgccaggtcctaccacgatgcctgactcgtttgcggctttgggaccggttgtaggtggcttgaccgtcactagtagacgtttctgagtgtgtcgcggtcaccatggtaacgactttagcttcccttccgcccttgcggtgacgtcactggcggaggccggactggggggaggttccctgctcaagctctcttctcttgtctgctgccatgtgagacgtgcctttgaccttctgccatgattgtgaggcctccccagccacgtgaaactatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatga

SEQ ID NO: 201252 - DNA, 1626 bp, Homo sapiens
  Payload ID: 19720
  Gene Name: zinc finger and SCAN domain containing 5B
  Uniprot ID: A6NJL1
  ENST ID: ENST00000358992
  CDS Start-End: 1-1488
atggctgcaaattggacactctcatggggtcagggaggaccctgcaacagccctgggtcagacactccacggtctgtggcgtccccagaaactcaacttggaaatcacgacaggaaccctgagacttggcacatgaatttcaggatgttcagctgcccagaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcaaggtgaacggtgtgcagagctgcaaagacctggaggacctgctacgaaataacagaagacccaagaaatggtctatagtcaacttgctcggcaaagaatatcttatgctgaactcagatgtcgagatggctgaagcccccgccagtgtcagagatgatccgagagacgtgtccagccagtgggcctcctctgtgaaccagatgcatccggggacaggccaggcccgccgagagcagcagatcctgcccagggtcgctgcactgtccaggaggcagggagaggactttctgctacacaagagtattgacgtaacaggtgacccaaactctccgagacccaagcagaccttggagaaggatctgaaggaaaacagggaagagaacccaggactgtcatccccagagcctcagcttccaaagagtcccaatctggtgagagcaaaggaggggaaggaaccccagaaaagagcctctgtggaaaatgtggatgctgacacaccttctgcctgcgttgtggagagagaagctttgactcacagcgggaacagaggagatgctctgaatctgagcagtcccaaaagaagcaaaccagatgcctcctccatttcccaagaagagcctcaaggagaagccacacctgtgggcaacagagaatccccaggacaagctgagatcaatccagttcattccccaggccctgcgggcccggtcagtcacccagatggccaagaagccaaggccctgccgccctttgcatgtgacgtgtgcaataaatcatttaagtatttttcccagctaagcatccacaggaggtcacacacaggagacagaccctttcaatgtgatctctgtcggaagcgcttcttgcagccctcagacctccgagttcaccagcgagtccacactggcgagaggccctacatgtgtgacgtctgccaaaagcggttcgcccacgagtccaccttacagggccacaagaggatccacaccggggagaggccgtttaaatgtaaatactgcagcaaagttttcagccacaaggggaacctgaacgttcaccagcgcacccactccggagagaagccctacaaatgtcccacctgtcaaaaggccttccgtcagctggggacattcaagcgtcacctgaaaacacaccgggaaaccacctcccagtgattccagagtcaggtccacatcctccaccccaagagacagtgaatgatggtttttctccaatgttaccagatgacatatacacataaagcacttggtaggaattgcccggatgtttgaataaatatttatcctccccca

SEQ ID NO: 201253 - DNA, 570 bp, Homo sapiens
  Payload ID: 19720
  Gene Name: zinc finger and SCAN domain containing 5B
  ENST ID: ENST00000589938
  CDS Start-End: 63-570
caggccggttggagagcgcatcccagaccgagaaggtcggaggcagaagccgggaaggagatatggctgcaaattggacactctcatggggtcagggaggaccctgcaacagccctgggtcagacactccacggtctgtggcgtccccagaaactcaacttggaaatcacgacaggaaccctgagacttggcacatgaatttcaggatgttcagctgcccagaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcaaggtgaacggtgtgcagagctgcaaagacctggaggacctgctacgaaataacagaagacccaagaaatggtctatagtcaacttgctcggcaaagaatatcttatgctgaactcagatgtcgagatggctgaagcccccgccagtgtcagagatgatccgagagacgtgtccagccagtgggcctcctctgtga

SEQ ID NO: 201254 - DNA, 2059 bp, Homo sapiens
  Payload ID: 19720
  Gene Name: zinc finger and SCAN domain containing 5B
  Uniprot ID: A6NJL1
  ENST ID: ENST00000586855
  CDS Start-End: 315-1802
tgggaaatgtaatcaacgccgattacgaaaatggactctgtggccctaaaccaatcacggcgcggcgcagggaaccggaaacgcggcctggagtcccgcttctccataaatagacgcagttcagctccaggccggttggagagcgcatcccagaccgagaaggtcggaggcagaagccgggaaggagacttctgaacaaactgtgaatatattactgagaagaaacaggggcagcctgtgtaaataggtctcaatttgatactggctactggaagagcttgctcagaggctgattgaaatattctccagtagatatggctgcaaattggacactctcatggggtcagggaggaccctgcaacagccctgggtcagacactccacggtctgtggcgtccccagaaactcaacttggaaatcacgacaggaaccctgagacttggcacatgaatttcaggatgttcagctgcccagaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcaaggtgaacggtgtgcagagctgcaaagacctggaggacctgctacgaaataacagaagacccaagaaatggtctatagtcaacttgctcggcaaagaatatcttatgctgaactcagatgtcgagatggctgaagcccccgccagtgtcagagatgatccgagagacgtgtccagccagtgggcctcctctgtgaaccagatgcatccggggacaggccaggcccgccgagagcagcagatcctgcccagggtcgctgcactgtccaggaggcagggagaggactttctgctacacaagagtattgacgtaacaggtgacccaaactctccgagacccaagcagaccttggagaaggatctgaaggaaaacagggaagagaacccaggactgtcatccccagagcctcagcttccaaagagtcccaatctggtgagagcaaaggaggggaaggaaccccagaaaagagcctctgtggaaaatgtggatgctgacacaccttctgcctgcgttgtggagagagaagctttgactcacagcgggaacagaggagatgctctgaatctgagcagtcccaaaagaagcaaaccagatgcctcctccatttcccaagaagagcctcaaggagaagccacacctgtgggcaacagagaatccccaggacaagctgagatcaatccagttcattccccaggccctgcgggcccggtcagtcacccagatggccaagaagccaaggccctgccgccctttgcatgtgacgtgtgcaataaatcatttaagtatttttcccagctaagcatccacaggaggtcacacacaggagacagaccctttcaatgtgatctctgtcggaagcgcttcttgcagccctcagacctccgagttcaccagcgagtccacactggcgagaggccctacatgtgtgacgtctgccaaaagcggttcgcccacgagtccaccttacagggccacaagaggatccacaccggggagaggccgtttaaatgtaaatactgcagcaaagttttcagccacaaggggaacctgaacgttcaccagcgcacccactccggagagaagccctacaaatgtcccacctgtcaaaaggccttccgtcagctggggacattcaagcgtcacctgaaaacacaccgggaaaccacctcccagtgattccagagtcaggtccacatcctccaccccaagagacagtgaatgatggtttttctccaatgttaccagatgacatatacacataaagcacttggtaggaattgcccggatgtttgaataaatatttatcctcccccatgagttttgttttctgtttgattatgtctgttgctttcttacagatttattttagtgtctgttgctgtttctcttccaatgagcaaagtctcatcattttccaatatctcataagaaaa

SEQ ID NO: 201255 - DNA, 555 bp, Homo sapiens
  Payload ID: 19720
  Gene Name: zinc finger and SCAN domain containing 5B
  ENST ID: ENST00000587032
  CDS Start-End: 145-555
ataaatagacgcagttcagctccaggccggttggagagcgcatcccagaccgagaaggtcggaggcagaagccgggaaggagacttctgaacaaactgtgaatatattactgagaagaaacaggggcagcctgtgtaaatagatatggctgcaaattggacactctcatggggtcagggaggaccctgcaacagccctgggtcagacactccacggtctgtggcgtccccagaaactcaacttggaaatcacgacaggaaccctgagacttggcacatgaatttcaggatgttcagctgcccagaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcaaggtgaacggtgtgcagagctgcaaagacctggaggacctgctacgaaataacagaagacccaagaaatggtctatagtcaacttgctcggcaaagaa

SEQ ID NO: 201256 - DNA, 1491 bp, Homo sapiens
  Payload ID: 19721
  Gene Name: zinc finger and SCAN domain containing 5C, pseudogene
  Uniprot ID: A6NGD5
  ENST ID: ENST00000376267
  CDS Start-End: 1-1491
atggctgcaaattgcacatcctcatggagtctaggagaatcctgcaacagccctgggtcagagccaccacagtccatgccatccccagcaactcaacttggaaatcatgacagtgatcctgagacttgtcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtagtcagttttcttggcaaggaatatcttatgcaggaatcagatgtggagatggctgaagcccccgccagtgtcagagatgatccgagacacgtgtccagccagcggacctcctctgtgaaccagatgtgtccggaggaaggccaggccagccaagagctgcagaccctgcccagggtccctgcactgttcaggaggcaggaagaggacttcctgctgccagagactactgtcatgaaaggtgacccaaaggctctgagacccaagccgaccttggagaaggacctggaggaagacagggaggagaacccaggacttacatccccagagcctcagcttccaaacagtcccacaggggtggtgggagcaaaggaggggaaggaaccccaaaaaagagcctctgtggaaaatgtggatgctgacacaccttctgcctgcgttgtggagagagaagcttcgactcacagcgggagcagaggagacgctctgaatctgagaggtctcaaaagaagcaaaccagacgccacctccatttcccaagaagagcctcaaggagaagccacacctgtgggcaacagagaatccccgggacaagctgagatcaatccagttcattccccaggccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtga

SEQ ID NO: 201257 - DNA, 1892 bp, Homo sapiens
  Payload ID: 19721
  Gene Name: zinc finger and SCAN domain containing 5C, pseudogene
  Uniprot ID: A6NGD5
  ENST ID: ENST00000534327
  CDS Start-End: 150-1640
ggaggcagaagtcaggaaggagacttctgaatgaacagtgaatctattactgagaaaaaccaggggtggcctgtgtatataggtcgcaattagacaccggcttctggaagagctttcccagagacagattgaaatattccccagtagacatggctgcaaattgcacatcctcatggagtctaggagaatcctgcaacagccctgggtcagagccaccacagtccatgccatccccagcaactcaacttggaaatcatgacagtgatcctgagacttgtcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtagtcagttttcttggcaaggaatatcttatgcaggaatcagatgtggagatggctgaagcccccgccagtgtcagagatgatccgagacacgtgtccagccagcggacctcctctgtgaaccagatgtgtccggaggaaggccaggccagccaagagctgcagaccctgcccagggtccctgcactgttcaggaggcaggaagaggacttcctgctgccagagactactgtcatgaaaggtgacccaaaggctctgagacccaagccgaccttggagaaggacctggaggaagacagggaggagaacccaggacttacatccccagagcctcagcttccaaacagtcccacaggggtggtgggagcaaaggaggggaaggaaccccaaaaaagagcctctgtggaaaatgtggatgctgacacaccttctgcctgcgttgtggagagagaagcttcgactcacagcgggagcagaggagacgctctgaatctgagaggtctcaaaagaagcaaaccagacgccacctccatttcccaagaagagcctcaaggagaagccacacctgtgggcaacagagaatccccgggacaagctgagatcaatccagttcattccccaggccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtgacttcaccatcgggtctgtcttctgcaccaagaaagtgtgaatgaagatttttcaccgatgttgtcagatgacgtttgacagatgaagggcgcctggcacgcagaggagtgccctagataggaattcctaggatgtttgtttaaatctttttcctccccgggggaattttggtttttgtttcattatttctattgttttaggtttattttggtttgtgttgctgttctttcaataaacatcttattagttttc

SEQ ID NO: 201258 - DNA, 1621 bp, Homo sapiens
  Payload ID: 19722
  Gene Name: zinc finger and SCAN domain containing 9
  Uniprot ID: O15535
  ENST ID: ENST00000252207
  CDS Start-End: 149-1333
ggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactg

SEQ ID NO: 201259 - DNA, 1791 bp, Homo sapiens
  Payload ID: 19722
  Gene Name: zinc finger and SCAN domain containing 9
  Uniprot ID: O15535
  ENST ID: ENST00000425468
  CDS Start-End: 166-1503
atctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatttaatacgaagtttgaggagaagggcagtactgatcccacttggggcccatctgttctctacagacacatttttattttccaaacctgttgtgatcccccagctaaaaggaggaggagaaacatggcctaacaacagaggagtcctaagagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactg

SEQ ID NO: 201260 - DNA, 579 bp, Homo sapiens
  Payload ID: 19722
  Gene Name: zinc finger and SCAN domain containing 9
  ENST ID: ENST00000531941
  CDS Start-End: 457-579
atacaaattccaggctaacggtgacagtggctgcctcggggagtgggactaaggaggggtaggtggggtttgacattttactttattaattttggtattgtctgagggtttttaaaccataaataatgtattaattttaaaaatgcttttaaaaatcatcattttcaatagttaacggtctatgcttcatcaacgttttccgtttaaaacctgtgtgcggcccacacacgtatgacattctgattatgtgattcactgctgaaaaagaactggacgccaggaaattgggggttgagtccgaagcaaggtgaacgccggacatcgagacatggaatcctagaccggcccggaagtgcctctgctccgtccgccttcgaggagaggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaa

SEQ ID NO: 201261 - DNA, 1601 bp, Homo sapiens
  Payload ID: 19722
  Gene Name: zinc finger and SCAN domain containing 9
  Uniprot ID: O15535
  ENST ID: ENST00000531979
  CDS Start-End: 113-1297
ggccattgttcgtgccgcgcttctagcaacgccgggccggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactgccacagccaacatgcc

SEQ ID NO: 201262 - DNA, 2062 bp, Homo sapiens
  Payload ID: 19722
  Gene Name: zinc finger and SCAN domain containing 9
  ENST ID: ENST00000527436
  CDS Start-End: 102-887
ctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgagggacagcatttatttgatgttgaacgaatcccacctggtcaagcaaaaacaaacaataaacccagagctgggaaaacaggagacccaaagactccttaccagatagcagtaatggtcagttcttctgagagcctagtgtgctcatctttgacccttctccctgcgtgcagacttctccctgagtaccaccctggaagctttctggacttctgatgcatggtacatgaggaaggctttcagggatcgctgtggagcacagcttcagagaatggacttcaaggtttgacagacaggttcagatcctggcatcgcctcatggaagctgcttgtattgggcagattacttaaccacttgacctcagatccctcatctacaaaatggggttgataatagctttggtttagtctacttgcgctgccttaagagaataccacagactggttgtctttaacagaaatttattttctcacattttcaaaggctagtagtccaagatcaagataccatcaggtttggtttctggtgaggcctcttcctggcttatagatggccatcttcttgctgtatcctcacatggcctttcttctgtatgcatacagagagagagcaagctctctcatcttataaggacagataccattcctacccgatagggcccttccttataacctcatttaacttttaataccttcctcaaggccctatctccaaatataatcatattgaggggttaggacctcagcatatgtgagggaatacaatttagtccgtaaccagtatgtacctcagaaagtcattgtgagtatcaaatacaatttatgaaaagcacttggcatgcattatgcttaatacatggtcactattgtcacaaatcaccagtgccacccttgctgatttgggttcatacttggagtagaaagatatcagatatgcttagtaagtggcagaactgtatgggagaatccagtgaaatcagactttgccatttccttctctgtaatcttctgagtggtggcagtgaccacccttgtggatatagtactgagcacttgggactgagtcagctgctttcccattctagccctccctgcaggaattggctctagcttgtctgatttcccacacataaaatcatgccctcttactgactttttgttaatgttctgacaatcaatctgtagcaaggttctactgttttcagtttcatattacccctatatgcatcaaagctgcaacttcccttgcctctttgtccctaggttctgtttatttcatttaccctagcaattatggatttctattacatggaactcatctcttgatttaaattaaagtgtatgtgttgagtaaattctgtgcagaccttcttatagcttctgtgacttta

SEQ ID NO: 201263 - DNA, 1182 bp, Homo sapiens
  Payload ID: 19722
  Gene Name: zinc finger and SCAN domain containing 9
  ENST ID: ENST00000527844
  CDS Start-End: 74-1182
gcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagacacatttttattttccaaacctgttgtgatcccccagctaaaaggaggaggagaaacatggcctaacaacagaggagtcctaagagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcag

SEQ ID NO: 201264 - DNA, 854 bp, Homo sapiens
  Payload ID: 19722
  Gene Name: zinc finger and SCAN domain containing 9
  ENST ID: ENST00000531981
  CDS Start-End: 141-623
gagaggtcggcatctttgttccctgcccggccattgttcgtgccgcgcttctagcaacgccgggccggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagtcaaatcttgtctttttgtccccagatggtggcccacagacacagacaagaagtcctctgtaaagagatggtgcctctagcagagcagacaccactgacccttcagtcccagcctaaggagccacagctcacatgtgactctgctcagaagtgccattctattggagagacaggtgagggacagcatttatttgatgttgaacgaatcccacctggtcaagcaaaaacaaacaataaacccagagctgggaaaacaggagacccaaagactccttaccagatagcagtaatggt

SEQ ID NO: 201265 - DNA, 757 bp, Homo sapiens
  Payload ID: 19722
  Gene Name: zinc finger and SCAN domain containing 9
  ENST ID: ENST00000526391
  CDS Start-End: 165-757
ctttagggcctatgataattgcttgtattatcagtttctgtcatcagctattatcatttttctatataaataatttatttttactgcttaggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacag

SEQ ID NO: 201266 - DNA, 7228 bp, Homo sapiens
  Payload ID: 19723
  Gene Name: zinc finger CCCH-type containing 10
  Uniprot ID: Q96K80
  ENST ID: ENST00000257940
  CDS Start-End: 277-1581
atgtcgcacgcgtacttcatacaccatagagtatggttccgggtctgctggctagagcgtcacttcttccgcaggaagcggaagagcgatcgggtaggcggctctttgtcgaagctagaggaccggcaggcggcagcagcaactacggcggcggcggcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaacaaatggaggcagtgaaaacttgcttagctattctgtgtggaagatgggagcagtaaatagatctcatgccaaaatgggataaagaccccagcctcacatagctttggtaagatggatagaagccagtgaagaagggtagggacccagaacaagaccaaatggggctttggggaaggcactttatggggtaaaagctttggagccacccagtctagttttaaaaatagtcccatctgtttctggtctctgtctgtatgtgctattcccaggttgcctcagtaaccagggctcctagggtcatttagcagggcaggcagtaaggagagtgtatttgctgaaatgcggatgggatgttacatagttgacagatccttattcaaacagagcaggacaggtggagttgatggccattgagttgatggcagttgccgctcagttgatggcagttaatgtccctcctaccccaccccttcagtggccagttcctgaagccttcaaggcttgggaggtctgggaaaagagagtccttctagggacacaagcctcagggtccatccctttcctctgtctccacataggaccagaagttttaaatctacttaagtcagtaaggccaggggccccaatagtcaaacctcagttcctcctcagctcacggctgatgtagggaaaacaactcaggtgtctagtctaatgggacagtagatttgggggtagagagtgatcctggattgtgttccccctcatcatgtctcctgctacctcttgctttcttgtctggttgatcactcaggtcacatctgggattggagatggtgggctaggtcaaggccagtcattaaaaaaaaaagcctaaagactaaaagtgggctaacattgtggattttagaaacaacacattgataagcttaatgttttttgggacacaatttttttttttttttttgagatggagtcttgcccagtcaccagaccggagtgcagtggcgcaatctcggttcactgtaacctgcgcctcctgggttcaagcgattctcttgcgtcagcctcccgagtagctgagactacaggcgcccgccaccacgcccggctaatttttttatttttagtagagacggggtttcatcgtgttggccagaatggtctctatctctcgtgatccgcccgcctcagcctcccaaagtgctgggattacaggcatgaaccaccgtgcccggcaattctagactattaaaagagatggtttaagagcatttagagaagaatgtaaccatagataccaacatgaattctcagtcaaatcctgactgactttatttcctccttgccaggttatctccaaagaggtagatttgggaaattttagacattgtatgtcttgtatgtatttactccagctgaagaccaccaagaatacacctggtaattgagcaagttgggtttaatgctcattgcagtgagggggagggctcaccattggggataacgtggtgtgtctcagcatgagggtgttaggaacgacttagagaacttagactttggttaagtgattttggggaagattcaagaaagtgggtgttcttttggattgggtgctgttaagggaatccaggataattgggtagcttgtctagaagaagggcagacaagtgaacctaagcacagtcgatgatgaagtcactcactagctgggaaaggggatgtttgctgttttgtggtttgcacactgaccttgttttgtgcttaaacaaaattgtgtagtgattttgttttttgtctcacttcatcgcagtcactgagtgaccttgtctgatgctggtgttttgtgagattgtttgtgtccaagagaactcattggctacctgtgagcaccaggtcagccctaacagctctgaagcctggctgtgtcaggccagttcccagattacaggagctactttcctctctctcacctgctaagtcatcacagataagaggaaaattacgggtcagttaatcgtagcattttttccatgcaaatggctctggttaaaaaataatgagaaaaaaatagtagcatttggtagaatcaaactgaacacttgtacttagtgttggttagcgcatttatgttagagaaatctctgttctctagtgataagcccaagggctatgttttattgtaaaaagaaaaaacccaactcgggtaaacatgtaaaaaacccatttatcaacagtaacacaggaagagctaaataatattcaaagtgtctgtaacttgaattgactaaaacactggagcactctcacactaaaaaattgcttagatcttgaactagtttgaggaacaatgttagagatttatattagcaataattcacatgagaacaaactgggacttccagttggctgcaaaaaaatagaatcttagccctcaagatgtccatttataaatatttattaagagcctgctatgttctaggcatctttctaggagctccataagggtagtagaaccttggtaatagattacaaatacagcagttctatgttctgcctaagtgtaaccacttagtagtgtgttgttctaaatgtaatttttaaagagggccattgacaaaccagtgtgttgctagaaaaaaaaggctggcaagagaaagcttcaaatagaagtcttcaaatatttgaagggctgcccagtggaggaagatcctgtttgctacacaggaagtaaaaagggatttctagaataatggctaactttttttttttttttttttttgagacggagtctagctgtgtggcccaggcttcagtgcagtggcacgatctctgctcactgcaaactctgcctccagggtttacgccattctgctgcctcagcctccagagtagctgggactataggtgcccagctaattttctttttgtatttttagtagagacggggtttcaccgtgttagccaggacggtctccatatcctgacctcgtgatccgcccacctcggcctcccaaagtgctgggattacaggcgttgagccaccgcacccagccggctagcatttgttgactgcttaatataagccaaggctctgtgctaggcactttacatgcaacatctcattgacacaatgggtaatattattgtacccattttacagaggagaaagcaggcttaaaaagtaacctgcccagggttctgcaagtaaggaatggggccaggaatctattcaggcagtctcactccagacgacaaaagaaagttctaatgatatagccatccaacaaagcgatcactacttggcagtaattttttttttttttttttgagacggagtatcactctgttgcccaggctggagtgtagtggcgtgatctcggcccactgcagcctccgcctctcgggttcaagtgattctcctgcctcagcctcccaagtagagtaactgggattacaggtacatgccaccatgctcggctaatttttgtatttttagtagagacggggtttcgccatgttggccaggctggtcttgaactcctgacctcaggtgatccaactgcctcggccttccaaagtgctgggattacaggcatgagccaccgcgactggcttggcagtaacttttgaggaataaagaatacagaaggagtttcctcaaatcttgttgcccttcccatctttgtgagctgagatcagagtaccgtatctcaccctctgcctcttggaggtgattatggtttacatataaatgcagattgcaagtccaggaagtttactctctctcctcctgtaggcctcatcctgtaagacacttcctctaacaaatgggcatcccttcctgttgtccacttactgcttatcaccaccaggtggcacctgggcagcagaattgtcagtgggcggggacccaccctgtttacttgtgttggtaactgcattgcagctgctgatcctgtggctcctgggccccagctgggacaagaacttcctgaggatgaagttttatcccctatataatttctgatgatctggatgaggtgaggaagggagaagtttggaaaagaacctccataggtcaccctctccattcccccattctcaggaacctccttgcctactccagtgcttggcaaatttcagtttatagagaggtttctctctaaggttcatccatgttccttctgtagttctgctttatcagttggtgagcaggtcactcataattcctccaatttccttgtttcccttttctacctgcttacctctgggaatatggaggatataggagacagaatattgtttcttaaatagttctgcaaactgaatgaagcagtcaagatactgctagccctagggaagtagagaaaaggaagtgaaaaaatttaagtgatagaggctgagcagggacaggttttaagcagctttggtaaacacaggctgatgaaatctatgccctgcagaaccagataaaatttatcagctgcaggcctcatcctgtaagacacttcctctaagaaatggctagtttcttcccagtgatcaaccccagttcttctgctgcatctgacagatttacataatatgccccatatatactgcattaaaaggtaatcatcttatgaccaacacttccctcatcaacttccaattagtctagttcctagatcctaggacaacactccacctctaacgccagttaactagtaacaatagtcatcggtgtaccctgcactttttccttcctaaacctacaccgtacactgtgggactgcactagttctgcacctgactgtatggcaaaccttccttctaactcaggcaaatgtgaaaaggaattgtctttcccttactcttgatccctcattttagtgtcctagaagttcttcagggtcagaaaattattggaaaatgtaataatttgcgctgcctccctcccttttggagccaactagtcttacatccatcctctaagatagagatgacttactaactcttggaaatttccaaaaagaaataaagcctcactttctattca

SEQ ID NO: 201267 - DNA, 1019 bp, Homo sapiens
  Payload ID: 19723
  Gene Name: zinc finger CCCH-type containing 10
  ENST ID: ENST00000551880
  CDS Start-End: 884-1019
gagggaggcgggagacttaggtggaggccgcgcccggaggggaggagtcggggccggcccagcggctgggctcggccaggccacagaaggccccccagaaccgagctggctcgtcctcacaccccagggcagtgccccttttctgagtgaccccgcatcgcgagcaaacgccagcttcgtgacgtcacaaccctgcccatcccctcagcttgatgacacctggagctccagctccccgcttcacttcgcgcgcccttagtgtcccattcacgtagcccacggctgagcgccggcggcactgcacggaacctgccaagctagaagacttgctgcgggaaaactcctaggacttctttcgcaaactctagggtgttgggaagcgtcacaatcactgccttcaagtctaatcggccatcccaatgcactgtcagacgctgcctttttgaggttcctcactagccattactaactccagcccttggcggtgctctgaccctcacatcctctttcatcttgaggcagggcgccccgcactctttgttcactcagggctggttttccaacccctcctcccagtccctccgaattagttttactcttcttactggcaacttctcccttggacaggtgaagttcagtttgaaccctgaggaaatcctcacgttctcgaagctttgccgttttgtcagatttcttgtgacaaccaccccatagtcctccactcttactccttcttccacccaagtctctgtttttttcctgctcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttct

SEQ ID NO: 201268 - DNA, 743 bp, Homo sapiens
  Payload ID: 19723
  Gene Name: zinc finger CCCH-type containing 10
  ENST ID: ENST00000546903
  CDS Start-End: 478-743
aaggccccccagaaccgagctggctcgtcctcacaccccagggcagtgccccttttctgagtgaccccgcatcgcgagcaaacgccagcttcgtgacgtcacaaccctgcccatcccctcagcttgatgacacctggagctccagctccccgcttcacttcgcgcgcccttagtgtcccattcacgtagcccacggctgagcgccggcggcactgcacggaacctgccaagctagaagacttgctgcgggaaaactcctaggacttctttcgcaaactctagggtgttgggaagcgtcacaatcactgccttcaagtctaatcggccatcccaatgcactgtcagacgctgcctttttgagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccg

SEQ ID NO: 201269 - DNA, 552 bp, Homo sapiens
  Payload ID: 19723
  Gene Name: zinc finger CCCH-type containing 10
  ENST ID: ENST00000552345
  CDS Start-End: 316-552
ctctttgtcgaagctagaggaccggcaggcggcagcagcaactacggcggcggcggcaggtgaagttcagtttgaaccctgaggaaatcctcacgttctcgaagctttgccgttttgtcagatttcttgtgacaaccaccccatagtcctccactcttactccttcttccacccaagtctctgtttttttcctgctcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgc

SEQ ID NO: 201270 - DNA, 5015 bp, Homo sapiens
  Payload ID: 19724
  Gene Name: zinc finger CCCH-type containing 11A
  Uniprot ID: O75152
  ENST ID: ENST00000332127
  CDS Start-End: 858-3290
ggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 201271 - DNA, 4365 bp, Homo sapiens
  Payload ID: 19724
  Gene Name: zinc finger CCCH-type containing 11A
  Uniprot ID: O75152
  ENST ID: ENST00000367210
  CDS Start-End: 214-2646
ctgcaacctccacctcccgggttcaagaagtttccctaccttaggctcctgagtagctgggactacaggattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtagg

SEQ ID NO: 201272 - DNA, 3004 bp, Homo sapiens
  Payload ID: 19724
  Gene Name: zinc finger CCCH-type containing 11A
  Uniprot ID: O75152
  ENST ID: ENST00000367212
  CDS Start-End: 541-2973
ggacgacggacggcagcggccaagcaagaagaaagacgtggcagcaagcgggagtcggggatagtgtcatcggttcgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaa

SEQ ID NO: 201273 - DNA, 3451 bp, Homo sapiens
  Payload ID: 19724
  Gene Name: zinc finger CCCH-type containing 11A
  Uniprot ID: O75152
  ENST ID: ENST00000367214
  CDS Start-End: 998-3430
ttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttaggatttggggatattccctgcccaaaaaattcctggaaaattgactagtattaagtctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacacttt

SEQ ID NO: 201274 - DNA, 682 bp, Homo sapiens
  Payload ID: 19724
  Gene Name: zinc finger CCCH-type containing 11A
  ENST ID: ENST00000432282
  CDS Start-End: 533-682
gacgctggcagtcttggttttctgctagtgctgctgctgctgggaggacgacggacggcagcggccaagcaagaagaaagacgtggcagcaagcgggagtcggggatagtgtcatcggttcggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttaggatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgc

SEQ ID NO: 201275 - DNA, 1892 bp, Homo sapiens
  Payload ID: 19724
  Gene Name: zinc finger CCCH-type containing 11A
  ENST ID: ENST00000453771
  CDS Start-End: 347-1892
gacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacag

SEQ ID NO: 201276 - DNA, 8404 bp, Homo sapiens
  Payload ID: 19724
  Gene Name: zinc finger CCCH-type containing 11A
  ENST ID: ENST00000495527
  CDS Start-End: 4317-6275
cctgattataggttgccatcagagacttactttttcactaaggctgtacctcagttatatgattgtgtcagagaaaaaattttcttaactttagagaatgttcaaagccaaaagatacacctgactgttgacatatggacccatgacccatccactgactattttattgtgactgtacactgggtttctttggaaactgcgtcttttctcaataatggcaggatccccgattttagaaagtgggcagtgctttgtgttacaggtttggctaaagactgtttgataaccaatattttacaagaattaaatgaccagattggtctgtggctttctccaaatttccttatccctagcttcattgtttctgacaattcctctaatgtggtacatgcaatcaaagatggtggttttacccatgtgccatgcttcctgcattgtttaaatatggtcattcaggactttttctgcgagcacaaaagcattgagaatatgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttcaggttctgttgatagctcagctgtagacaatgttgcccttggaagcaaaagcttcatgttcccttctgctgtagcagttgtggatgagtacttcaaagagaagtattcagagttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacacatctggggaaacctgaaatcacacaagggctgaaaattcctcagaggcaatataattttgataaaatgaagattaaagatttcatagctataactgtggcgctagcacttgaaaattttgcttataccaatgagagagaagatatttttaattaaaaaaaatatagtgcagcattgaaaggccttaggctttcttcctggtagattgaactagtaattggttttaagtaaaacttcccccaccatgggaaattttattgctctgaaatcaacgaaatgagaaaaaagtacactggctggcattcctcctgcccctgtttttctgtttccttaaaaaccctgatgcttaattacaacttggcaaaaagaaaacccgtgaaattgttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagatattttctgccctttgtagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaa

SEQ ID NO: 201277 - DNA, 7979 bp, Homo sapiens
  Payload ID: 19724
  Gene Name: zinc finger CCCH-type containing 11A
  Uniprot ID: O75152
  ENST ID: ENST00000545588
  CDS Start-End: 3828-6260
atgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttcaggttctgttgatagctcagctgtagacaatgttgcccttggaagcaaaagcttcatgttcccttctgctgtagcagttgtggatgagtacttcaaagagaagtattcagagttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacacatctggggaaacctgaaatcacacaagggctgaaaattcctcagaggcaatataattttgataaaatgaagattaaagatttcatagctataactgtggcgctagcacttgaaaattttgcttataccaatgagagagaagatatttttaattaaaaaaaatatagtgcagcattgaaaggccttaggctttcttcctggtagattgaactagtaattggttttaagtaaaacttcccccaccatgggaaattttattgctctgaaatcaacgaaatgagaaaaaagtacactggctggcattcctcctgcccctgtttttctgtttccttaaaaaccctgatgcttaattacaacttggcaaaaagaaaacccgtgaaattgttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtagg

SEQ ID NO: 201278 - DNA, 2684 bp, Homo sapiens
  Payload ID: 19725
  Gene Name: zinc finger CCCH-type containing 12A
  Uniprot ID: Q5D1E8
  ENST ID: ENST00000373087
  CDS Start-End: 117-1916
atataaaggcgccgccgtccttacccccaggactcggccccatggagacgccgccggccgccgctggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctttcaaga

SEQ ID NO: 201279 - DNA, 395 bp, Homo sapiens
  Payload ID: 19725
  Gene Name: zinc finger CCCH-type containing 12A
  ENST ID: ENST00000471012
  CDS Start-End: 1-395
gacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagcttgccatcggccccttctcagcaattagaagtccctgcatggctcccacctccagagagttctttgcaccctctgcaggtttatgccccctgatgacccactgggccggcacgggcccagcctggacaacttcctgcgtaagaagccactcactttggagcacaggaagcagccgtgtccctatggtatggaacccagcctgccctccccggccctcctcactcctgcccttcctctcacctgtctg

SEQ ID NO: 201280 - DNA, 7256 bp, Homo sapiens
  Payload ID: 19726
  Gene Name: zinc finger CCCH-type containing 12B
  Uniprot ID: Q5HYM0
  ENST ID: ENST00000338957
  CDS Start-End: 68-2578
catgtggattccaagcaggctaaaaagaaaaagaactgattagacctcagacgacccactaaacgggatgacggccacagctgaggtagagacaccaaaaatggagaagagtgcctccaaggaagagaagcagcagcctaagcaggacagcacagagcagggcaatgctgattctgaagagtggatgagctctgagagtgaccctgaacagataagccttaagagtagcgacaacagcaagagctgccaacctagggatggtcagttgaagaaaaaggagatgcactccaagccacaccgccagctctgtcgatcaccctgcctagatcgtccaagtttctcccagagcagcattttacaggatggtaaacttgacttggagaaggaataccaagctaagatggagtttgcgctaaagctgggctatgcagaggaacagattcaatcagtgctaaacaagctgggcccagaatcacttattaatgatgtattggcagagcttgtcagacttgggaacaaaggtgattcagaagggcagatcaacttgagtctgttagtgcctcgtgggcccagctccagagagattgcaagccctgaattgtctcttgaagatgaaatagataacagtgacaatttgaggccagttgtcattgatggaagtaatgtggcaatgagccatgggaataaagaagaattctcctgcagaggaatacaacttgctgtggattggtttctagataaaggccataaagatattactgtatttgtgcctgcatggagaaaggagcaatcccgccctgatgcaccaattacagatcaagatattctacgaaaactggagaaggaaaagattcttgtcttcacaccatcccgaagagtccaaggcaggagggttgtctgctatgatgaccggttcatagtcaaactggcttttgattctgatggcatcattgtgtccaatgataactaccgagaccttcaagttgaaaagccagaatggaagaagtttatagaggagcggttgctgatgtattcttttgtgaatgacaaatttatgcctccagatgatccattaggacgccacggcccaagccttgaaaatttcttaagaaagagacccattgttcctgagcataagaagcaaccatgtccttatggcaaaaaatgcacctacggccacaagtgcaaatactaccatccggagcgggccaaccaaccccagcgttcggtggctgatgagctccgcatcagtgccaaactgtccacagtgaaaactatgagtgaaggcaccctggccaagtgtggcacagggatgtctagtgccaaaggtgagataacctcagaggtcaaacgtgtggcccccaagcgccaatcagatcccagcatccggtctgtggctatggagcctgaggaatggctgtccattgcccgtaagcctgaggctagttctgtcccctcgcttgtgactgccctaagtgttcccacaatcccaccccccaaaagccatgcagtgggtgcactcaacacccgttcggccagcagcccagtgccaggatcctcccatttcccccaccagaaggcctctttggagcatatggccagcatgcagtatcctcccatcttggttaccaacagccatgggacccctattagctatgctgagcaatacccaaagtttgaatccatgggggaccatggctactattcaatgttaggtgacttctccaaactgaacatcaacagcatgcataaccgagagtattacatggctgaagtagaccggggggtgtatgcccggaatcctaacctctgttctgacagccgtgtgagccataccaggaatgacaactattcctcttacaacaacgtgtatttggctgtagctgatacccatcctgaaggcaatttgaagctgcaccgctcagcatcccagaaccgacttcagccttttcctcatggttaccatgaagccttaacacgagtgcagagctatggcccagaggattctaagcaaggcccccacaaacagtcagtcccccacttagctctgcatgcccagcacccatcaactggaacacgttccagctgtcctgcagactaccccatgcctcccaatatccatcctggggcaaccccccagccaggccgtgccctggtgatgactcggatggatagcatttccgactcccgcctctatgagagcaaccccgtgaggcaaagacgacctcccctgtgccgggaacagcatgccagctgggacccgctgccctgtacaactgactcctatggctaccactcctatcccttgagtaacagcctcatgcaaccatgttatgagccagtcatggtacggagcgtgcctgaaaagatggagcagctttggaggaatccttgggttggaatgtgcaatgattccagggagcatatgatcccagaacaccagtatcagacctacaagaacctctgcaatattttcccttctaacatcgtccttgcagtgatggagaagaatccccacacagcagatgcccagcaactggcagccttgattgttgctaagcttagggctgcacgttgatatgacatagtacttatttctttatacaaatatgaatattaatactaataatacactaatacaataattatagtaactaataatttgtgttgcgctttacaagttagagtgtttatatcatttaagcgcttaacaaccctgtgaggtacgtcttactaacatcctcttttatagagaaggaaggtgaaggtcagtgaaattaagtggctagccagggtcacactgctagcaaatgactaagtcaagacacacacccaagtcctctaaatccaagtcccatgcccctttgcactgcaccatgcaggtaatggaggacaaaacccagggggagaggtctagatgtaagaaatcccagaggattccattaccagagttttcctttttctcttttcgtttctttctttctttctttattttttttttttgagacagaatctcactctgttacacaggctggagtgcagtggcactatctctgctcactgcaacctccacctccagggttcaagtgattctatggcctcagcctcccaggtagctgggattacaggcgtgcaccaccatgcccagctaatttttgtatttttagtagagacgtggtttcaccgtgttggccaggctggtctcaaactcctggcctcaagtgatccgcccaccttggcctcctaaagtgctgggattacaggtgtgagccactgcgcccagcctaccagagttttcgtagtcacatattctatattacaaagtatggatgatatatccaatttagagagcaaaagcatcaggatcagatcatatgttgaattaaccttttaggttttttctaatagaaatatttaaagctatttaaaagtaaatgcatactttattgcatggatatctgatcactcaatctatattaatgaaactatagggtcacattgaagcttctagaactatattttaaagctattattagcaattatattgcatgtatgaatatatatatttggtttgagatgtgtgtgtatctctgtataaccttttatatagtgataatgagagggtaggctctacacagtccttcgtctatagctgtataggtcactaatctgacttgatgattttaagtcacatttcatagttttaactagttatgagagagaaattatatggcaatatttgaacattgctttcttaggcaccagagcaaagcaactctgtttcctttgcacattttacctgccaacatttattaacagttcttaccttccaagtctcttcaccttagcaaattagggatcaggttgcagtcttctgcagagaaactgatggttaagctcaagttccaagcatagtatgtgtgtgctacacaagctcagaagagtttgacaaggaccaggggacttactaccacaatccacttcccttatcccaggagagatggccaaacccatgtggcattaaatggtgaataaaaaagcttcactcaaggagggactattggatgctctttggacttctgacctatgcagtattcaacatcattggatgaaatgtaatggaggacagtgcacagccatgtatccactttctcttcctgtccaccctttgggtaataaggtcaatcattggtggaacagaatttctctaggaaacaaaaccaggggattttatttgtggaaaaaggaagtttccaaaaggggatactgcatctttactaatagctggctcagttactcactttaaatccatgcaaagagtgcacttgctgttaaataattgttaaatgagttattagaaggcaggacttttggtttgggcgacaccatttgcgcaacttgtatcttgctcagggtggaaaacttcatagctaaatgcctctagaagaggtgtttattgttttttttaagctgcactaaatgaattccctttttgaatccattgtatatttcaatatttcgaaccatgatcagctcactatttcctgagctggaacttgctaacttctatgatcgttttttcatgaaagttgagaaggccgggccttggccttttgtttcttcatgagaaggtgtgacactgcctataaatgtttcttactgtgaaacactctgaatgtgaggctgtagtcagggttgtttctggtggtttgacaatggcttgcatgctgctttctggctttctgtctctgtccaagttgatcaatactgcatcttaaccaatgtttcacttgagttaaccacagctttacattctatctcctatcttctgatcttcgtataccccagcatattgaaaaagagtaaaagtattttctatcaatcaggtagatccacagagtgacagttgccactgcagtgcttgctatttcacacaaacaccatttcataccttcaacttcttggactttctaaatcggactcgtgtctaaatcagggtatttgacaatctcagatgatgctactgcctatgtgccagttagttcatcttcctaccaagatcatgaatggcaccacactatccactagctgtacaatttacagagaagcacaagattcatcttgtcacctacaattcgtcttgaacatgttcatatttagtactcagaaactgtgtaagctcctcccaatacagaaaatattttttaaggcagcatatgtatttctgatttactaaaaacgattgtcattctcctctcattcttctttttggtatgaaccaaaagcggctaggagcaatgcctcaaataaccagaaatgaccttttgttgatacaaattgtatctctttttttcctgattgtatagaaacaaatgtacaaaactcatctgaagctaggtttggcactgaattttcaccatgaggtttgtggcactgtgtgtcacagggaagtagctcaggggttgtgagggagcttttatttctaaagggcagtagtaatttatagacaaaaacaatttttcaaggcctctttattaccactgcacagctatcatgtgtaaaatttcaagcattatattgcataagttctctttagcctattaaatttaatatgtccttgcaaaagggattttgtgtaaaaagtgtcagtgttagtgactcatctgcaagaatctacaaatggagctatacaactatgaatacataaatacagcatggttcctagttattagagaaacattttctttatattgaggtctacgcacttcttgactttccattttgtctgtaattataaaacagcaaataacaaagaagcattgggaccccctcggctgccttgataataaaatcaagcttccttcatgggactaagcatgtgtccttcaggatacttacctctaagcactcagcaggggttactacaaagcgttttgtgtggttttcaaaaaacagtgtattttgcaagaggtgctttgtaattttaattatttcactgattttctgacctcataggaagtctgtgcctgttgaggccttcaattttgtagcttttctgattttttttcttctttttgtgattttgttgttgttttcattttgatctaaaggagaagtgtgaccccggagtggcatggtcaatccagggcaccctttctgtaagacaactcaaaggaaaagaagccttttcaaaggtaatatcgagccattgcactctctcttaaggtgccaggtatgggagaatgacagatgccttatggaaatggtctacaaaacttttcttcttctaagtaataaaacacatagcatgattctctctccctctctctctctctctctgcccaccccctgctagtttccaggagaatacttctctaaaattcatttttttctattttggaataaattatctttatacagtaattcaaacactgatttccattaacctttggccctgagttttcttctaacatagaagagttcattttgagaggcactcagttaccattcaatctgtgctgtaagtatgggactttgtacaaatgccctttttgagggccaaaaatttcaatacactttgttctactttgtgaaccaggtctggatctgcacagagaaagtaatgctgagctgtccaaagagtccgctcaggtctccctcctaaccctcctctgccttcccctagtttgcttatcctcacgtctgacactgaggagtgcatagtcttcaactgaaatggcactacagttagttctcattggaaacaaacaagtgtatttctggaacctgctcgtctaaaatagtcaatgcctttgtaaagactcagcatattcaatatctattgtatggtagctagctatatacatagattgactatttttagtcctggtttgtgtattgttgagctatagtagtttgctttatccatttgtgggattaaacaatactgtttaatggttgtaaacttttataaaatctctttgggttttttgtttgacccaaacataatgtaagtcttaatgacaaaatacacaaagttaaccagaggtgagtgaaaatatagcccttccccagttttgtctgcccctataatgcacgtgcattgctttgtaatatgctctcgctagcatgaatgtgctatgactacttcatgaggttttgtttcacctataattgtgatggaaaatgctgtattgctgacaacaatgaactgtaaccacagttatttactgcataaactatttgtgtactaacca

SEQ ID NO: 201281 - DNA, 8807 bp, Homo sapiens
  Payload ID: 19727
  Gene Name: zinc finger CCCH-type containing 12C
  Uniprot ID: Q9C0D7
  ENST ID: ENST00000278590
  CDS Start-End: 52-2703
gcttctccgcgggccccgccgcccgctcgccgctttctcgcggggctggctatgccgggtggcggctcccaggaatacggggtgctttgcattcaggaatacagaaaaaacagcaaagtggagtcaagtacacgtaacaacttcatgggcttgaaggatcacctagggcatgacctcggccacctttatgtggagagcactgacccacagttaagtccagctgtaccttggtcaacagtagaaaacccaagtatggataccgttaatgtggggaaggatgaaaaagaggcgtctgaagagaatgcaagctctggtgactctgaagaaaacacaaattctgatcatgagtcagaacaattgggtagcatttcagtagagccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaactttttttttttaacatttcctttttaaagctatatccttggctggaaatttttccagtttgatttaatagatgtatctgtgatctttgatattaatctttggtgcatcaggggtttatatgcagcactttttatccttgttttgtgttttattaacttggtgtttgtctatcaattgcaagcaattacaataccttcagaatgtgggacatttgactagacctagcaaactgttttttcgagccaagcttagttagactcttttacagctttttaagttatttttatttggggaaagtgggcttctttgtgctataatcattatttatagaaacaaagttatactacagcactgactttatattttaaacagaatgtaagttaccagttttatgttgaaatgtgttacagtatatatatattagaatgatttacaatatggcacttttcgatgtgttatttttgtttggatttttttttctgttaagaaattagttaatttaatatggtcaatttaaaagaaagcagatgcaatcaatggaaaaatgtttccattttttaaaaatgaataaggcaaaagctgtaactgttacaggttagagctttgttatccagctatgatgtgcttcttgacagtagaagtggaattgaattcctagatttccattaacctgtatttttaatatgtctgtctttttgttttggggcacaacaatactggataaaataaccctttcacagcacttgcctgtttttaatgaatctaattattcacaatgcaacttttatatttaacatactctttagctttcctgctatttatcaaggctggcctgaggtgggtttatgtgttgaggttatgcaacatttcttgatactgcactatagagaaatggtgatggaggagttgtaaatggtaacttaaaatttttgtaagatattgtatattttccattttcctgaaggtagttttcttgggggggcctgttatattattaaggccagactcttgccacaaatagtgtagttttagatacagactaaggtctgttctagtattagtaagggatatttctggtttcaaagtcatgggttttgctagtggtgaatacatttctgcggagtagaagatagattttgcagtcagtggcagacagttgtgtgattgacatcacttgactgttgcgtccaggttttgaattgtacttcacgtaacagatgcattcagatctttttctgtagtctgcttagatgccctggctattctgattatcctacatgctacagtttgaagtgaagccctgaaaaaccagaaagtaccttttactgttgatacaaattgtatctttttaactataagaactattttgatttgtagatctagttaaaacacaagtatgtaactatgattagacttttgggcaacattttatcccttatttaaatacaaatttttaaagtaaaattgaggtctagaatagattagaaaataaaaataacaatttagataaatagaaatgtctgtcttagttttatataatatattaaaacacagtaaataaatttattggcattttctttctcctaaaacttacctagtgtgaacttaaaataaaggtaaaatgctgcctgaaaataatgtccaagcacctttgactaggataacattttcactacttgtgtgacactgtgtgttgcacgaagtaggatttgggtatacagtaaatgcttctaaaaggcattgtgcatattgacataaccaataatctgaaccgtgttcagcaaacttaattcaggaaagtggtattctacacaattattgctgttgtgtttgaaatgagtgtggcactcatctgtatccagaaataatatgggtgaggccacacaacccattctgagtggtgtctgtctgaaagcaaccctactcgcatgtgaaattgttctccttgatttggtcactataaagcaagtttaaatgtagaggctaactcagtgccaaaaacagggttacaaatgtgtagtatcttttattttagtcatattctaagacttctttttagtatgaaatcacttttaaattatacatgtaggttttgcttccattttcttcattttaccattttaattatttgaacattcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttttattcttggtattttcaaagaattattttgatatttttaatagaatgtgtaattttaaaatacacaaaaaacttaaagtagtattgattatacaaataattatttaacatgtcttatggatgtatctatatgtatatagacagtaatatatttataaaacaaatatactttgcttatgttatagctcttagtttgtgacaggtgggaggatggctctgggtgtgtgtgtgtgtgtgtgtgtgtgtgtgtgtgtgtgtgtgttttgaaaactctcaagctgttttccctctgatttacaatggtatttactttaaagtatgtttggttttcattattctttttgctctccaacttccttattcaagataaaataagacatacagttttctggccattctgttggtgtgtggtgcacccattttattgtcatctaactcctggagaattcccacgtgacctgaaatcaaacagattctggctggacatatgcttatgttccaaatatattaaagatgttaattcagctaacagttaagtttccaaggtatacaccaacaaataaaatgaggtattaaaaagagatggattacacacatgcattagaataagagaaaacagtagtgttaataaaagtaaagaaacatacactatcttagccccctagggcaggggttgactttttctgtaaaggatcagatagtaaataatacaggaatcatatggacttcaaatgccattgtaaaaactactcagctctgcctttagagcataagaacagccacagataacatgtaaattagtgtggctgtgttccaataaaactttatttacagaaacgggaagccggtcagattgggcctgtgggccataatttgctgatctcaagcagtaaatcctggtatatgttaatagaagaaatcataattgcatttcagttgacattaaaagaaaatctggtagtttttgatgtccttcaaaagaggattgttagacattgatgttaaagcatcttaattcatttgagttttcttacctgtttacacccattatttattagagatatttcttgtgtttaaccacaaaaaaaagcactctgttaaaatgttttaatatgtattgaatttctttcataaacttttcatttctgttgataaatgggaatcccttaccaaccttttgttttttaaaagtctcatagaccaaaaaaaatctgttgcagcatttaattagccacagatacattttggctgcatttaccagttacatttttccattggttttggcttctaataaataacatatctgccattctttaaaaatgattttaaagaagataaatatattgtaatttcacatgctatagctttattctgtaagattaaaaattgtgactagtataattgtagctataatgtgagtggcatgttacaatgtaactctttatgagaaataaaatgtatctctgctttgtctgtccagatctttaggatttttagatgccttgggactgtccttggtgaatgatattcttcatatgatcatatgtaattttgaattcgttggaagtacacgctgctgagcatgtttattcacagtgctttataccgggtgttgcatcagtaatcattttcataagaacatttaaacagcatgaacatcatcatccacttaaatagttaaactttcttttaaaattggaatgcaactgtaggttttaacaatgtttattgttttttaagtggttactttgtttttccttaatactttctgttaacttaattattactcctgttgcagtgttactgttatgtattagaagtggcttttccccctaagatccttagtcttttaaagacaatttaaggtattggccatttggcagtagaaaatgtgcatgttttaacttggttttataaaatctgtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccaggttattgattttatcttttcctttcagggttttgtcctcccaaaccagagtcatatgctgctagtagaattttttatttgatcctgcgaacttttcttataggaaaagtaaggcaaaggatgtgtagtgcaaccatctgataaactagtgtgattgtatttatcctctgttctgtgtatttctgtaatggaatctttacaattcccaaaacggtattttagacctactggaaatctgtatcgaaacagctatgtgattctgccactgagaaaaaaaaaatttttaattcgtttttcttatgctggtttgtttttctttaatgaagaaattgatctcatatggcatcatagatgctaaataaataaaagcatcatacttctctagtttgcctgcattcagtggctaacattatgagcattgtgtaagataaacacatggtcagtatcaatgtaaatgttagagccatgattaattcctatgaaaattgaaattaaatgtcaaagacaactagacataa

SEQ ID NO: 201282 - DNA, 9542 bp, Homo sapiens
  Payload ID: 19727
  Gene Name: zinc finger CCCH-type containing 12C
  ENST ID: ENST00000453089
  CDS Start-End: 882-3440
aagtgcagatagaataaaacttttaccttttcctggaatgaaatagactgttgtttccctggcacttaataaggatagcataatgctagaaattatattgtgttactatgttccatagtcaaaaaatcatgattactagggcaaaaccctgttcatctcttaagaagaatttaactcactttgtaattatttaattcccttctgtctatcttagaatatgtgctctttcattgcagtatctatgttatttttgaaagttctttagattgctgttaagcttcatccagattaataatgatttttcaagtataagttaatggtttctttctatgtggctttctttttaaaagaatatttatagatacttatgaattctgttagagaaaaatgtaaattttaacctgtcatgcatattaaaaacatactttttgatgatattctatgtgtcactctagaattataagccgtcctaaaagtagaaaaatctgatccatcgagattgagaaggagcatgatatagtgggaaaagcatgggttttagaatcagacgaaactgggtaaaaaaatacagttctactacttatttactttgttgccttggaggaattacatggcctttctaatttatgacttcttcatctgaaaaatggcagatgatactctcttggcaagggtgttaggagggaggagaggatgtagacaaaatacaaagtattttgagtagttgagtaattctcttctgacttctccattgagacagaaatctagccataactatgaaattctaaatattttacatttttctctaggaatacggggtgctttgcattcaggaatacagaaaaaacagcaaagtggagtcaagtacacgtaacaacttcatgggcttgaaggatcacctagggcatgacctcggccacctttatgtggagagcactgacccacagttaagtccagctgtaccttggtcaacagtagaaaacccaagtatggataccgttaatgtggggaaggatgaaaaagaggcgtctgaagagaatgcaagctctggtgactctgaagaaaacacaaattctgatcatgagtcagaacaattgggtagcatttcagtagagccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaactttttttttttaacatttcctttttaaagctatatccttggctggaaatttttccagtttgatttaatagatgtatctgtgatctttgatattaatctttggtgcatcaggggtttatatgcagcactttttatccttgttttgtgttttattaacttggtgtttgtctatcaattgcaagcaattacaataccttcagaatgtgggacatttgactagacctagcaaactgttttttcgagccaagcttagttagactcttttacagctttttaagttatttttatttggggaaagtgggcttctttgtgctataatcattatttatagaaacaaagttatactacagcactgactttatattttaaacagaatgtaagttaccagttttatgttgaaatgtgttacagtatatatatattagaatgatttacaatatggcacttttcgatgtgttatttttgtttggatttttttttctgttaagaaattagttaatttaatatggtcaatttaaaagaaagcagatgcaatcaatggaaaaatgtttccattttttaaaaatgaataaggcaaaagctgtaactgttacaggttagagctttgttatccagctatgatgtgcttcttgacagtagaagtggaattgaattcctagatttccattaacctgtatttttaatatgtctgtctttttgttttggggcacaacaatactggataaaataaccctttcacagcacttgcctgtttttaatgaatctaattattcacaatgcaacttttatatttaacatactctttagctttcctgctatttatcaaggctggcctgaggtgggtttatgtgttgaggttatgcaacatttcttgatactgcactatagagaaatggtgatggaggagttgtaaatggtaacttaaaatttttgtaagatattgtatattttccattttcctgaaggtagttttcttgggggggcctgttatattattaaggccagactcttgccacaaatagtgtagttttagatacagactaaggtctgttctagtattagtaagggatatttctggtttcaaagtcatgggttttgctagtggtgaatacatttctgcggagtagaagatagattttgcagtcagtggcagacagttgtgtgattgacatcacttgactgttgcgtccaggttttgaattgtacttcacgtaacagatgcattcagatctttttctgtagtctgcttagatgccctggctattctgattatcctacatgctacagtttgaagtgaagccctgaaaaaccagaaagtaccttttactgttgatacaaattgtatctttttaactataagaactattttgatttgtagatctagttaaaacacaagtatgtaactatgattagacttttgggcaacattttatcccttatttaaatacaaatttttaaagtaaaattgaggtctagaatagattagaaaataaaaataacaatttagataaatagaaatgtctgtcttagttttatataatatattaaaacacagtaaataaatttattggcattttctttctcctaaaacttacctagtgtgaacttaaaataaaggtaaaatgctgcctgaaaataatgtccaagcacctttgactaggataacattttcactacttgtgtgacactgtgtgttgcacgaagtaggatttgggtatacagtaaatgcttctaaaaggcattgtgcatattgacataaccaataatctgaaccgtgttcagcaaacttaattcaggaaagtggtattctacacaattattgctgttgtgtttgaaatgagtgtggcactcatctgtatccagaaataatatgggtgaggccacacaacccattctgagtggtgtctgtctgaaagcaaccctactcgcatgtgaaattgttctccttgatttggtcactataaagcaagtttaaatgtagaggctaactcagtgccaaaaacagggttacaaatgtgtagtatcttttattttagtcatattctaagacttctttttagtatgaaatcacttttaaattatacatgtaggttttgcttccattttcttcattttaccattttaattatttgaacattcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttttattcttggtattttcaaagaattattttgatatttttaatagaatgtgtaattttaaaatacacaaaaaacttaaagtagtattgattatacaaataattatttaacatgtcttatggatgtatctatatgtatatagacagtaatatatttataaaacaaatatactttgcttatgttatagctcttagtttgtgacaggtgggaggatggctctgggtgtgtgtgtgtgtgtgtgtgtgtgtgtgtgtgtgtgtgtgttttgaaaactctcaagctgttttccctctgatttacaatggtatttactttaaagtatgtttggttttcattattctttttgctctccaacttccttattcaagataaaataagacatacagttttctggccattctgttggtgtgtggtgcacccattttattgtcatctaactcctggagaattcccacgtgacctgaaatcaaacagattctggctggacatatgcttatgttccaaatatattaaagatgttaattcagctaacagttaagtttccaaggtatacaccaacaaataaaatgaggtattaaaaagagatggattacacacatgcattagaataagagaaaacagtagtgttaataaaagtaaagaaacatacactatcttagccccctagggcaggggttgactttttctgtaaaggatcagatagtaaataatacaggaatcatatggacttcaaatgccattgtaaaaactactcagctctgcctttagagcataagaacagccacagataacatgtaaattagtgtggctgtgttccaataaaactttatttacagaaacgggaagccggtcagattgggcctgtgggccataatttgctgatctcaagcagtaaatcctggtatatgttaatagaagaaatcataattgcatttcagttgacattaaaagaaaatctggtagtttttgatgtccttcaaaagaggattgttagacattgatgttaaagcatcttaattcatttgagttttcttacctgtttacacccattatttattagagatatttcttgtgtttaaccacaaaaaaaagcactctgttaaaatgttttaatatgtattgaatttctttcataaacttttcatttctgttgataaatgggaatcccttaccaaccttttgttttttaaaagtctcatagaccaaaaaaaatctgttgcagcatttaattagccacagatacattttggctgcatttaccagttacatttttccattggttttggcttctaataaataacatatctgccattctttaaaaatgattttaaagaagataaatatattgtaatttcacatgctatagctttattctgtaagattaaaaattgtgactagtataattgtagctataatgtgagtggcatgttacaatgtaactctttatgagaaataaaatgtatctctgctttgtctgtccagatctttaggatttttagatgccttgggactgtccttggtgaatgatattcttcatatgatcatatgtaattttgaattcgttggaagtacacgctgctgagcatgtttattcacagtgctttataccgggtgttgcatcagtaatcattttcataagaacatttaaacagcatgaacatcatcatccacttaaatagttaaactttcttttaaaattggaatgcaactgtaggttttaacaatgtttattgttttttaagtggttactttgtttttccttaatactttctgttaacttaattattactcctgttgcagtgttactgttatgtattagaagtggcttttccccctaagatccttagtcttttaaagacaatttaaggtattggccatttggcagtagaaaatgtgcatgttttaacttggttttataaaatctgtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccaggttattgattttatcttttcctttcagggttttgtcctcccaaaccagagtcatatgctgctagtagaattttttatttgatcctgcgaacttttcttataggaaaagtaaggcaaaggatgtgtagtgcaaccatctgataaactagtgtgattgtatttatcctctgttctgtgtatttctgtaatggaatctttacaattcccaaaacggtattttagacctactggaaatctgtatcgaaacagctatgtgattctgccactgagaaaaaaaaaatttttaattcgtttttcttatgctggtttgtttttctttaatgaagaaattgatctcatatggcatcatagatgctaaataaataaaagcatcatacttctctagtttgcctgcattcagtggctaacattatgagcattgtgtaagataaacacatggtcagtatcaatgtaaatgttagagccatgattaattcctatgaaaattgaaattaaatgtcaaagacaactagacat

SEQ ID NO: 201283 - DNA, 2931 bp, Homo sapiens
  Payload ID: 19727
  Gene Name: zinc finger CCCH-type containing 12C
  Uniprot ID: Q9C0D7
  ENST ID: ENST00000528673
  CDS Start-End: 80-2734
attgttcttcttgcctgcctggaagtctgcagctaaaattgtgttaaggagtttactgctgaagctgctacagaaaccaatgtctttgtattttcctgctaacgaatacggggtgctttgcattcaggaatacagaaaaaacagcaaagtggagtcaagtacacgtaacaacttcatgggcttgaaggatcacctagggcatgacctcggccacctttatgtggagagcactgacccacagttaagtccagctgtaccttggtcaacagtagaaaacccaagtatggataccgttaatgtggggaaggatgaaaaagaggcgtctgaagagaatgcaagctctggtgactctgaagaaaacacaaattctgatcatgagtcagaacaattgggtagcatttcagtagagccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaa

SEQ ID NO: 201284 - DNA, 5791 bp, Homo sapiens
  Payload ID: 19728
  Gene Name: zinc finger CCCH-type containing 12D
  Uniprot ID: A2A288
  ENST ID: ENST00000409806
  CDS Start-End: 320-1903
cttaaaaaaaaaaaaaccaaaaaaacccaaagcataactacttttgcagctgaacgtgactgtggcgtgcaggaagtggagcattggcatgaagtggctcctagtggctgcttggcgcacgccagctgccctcctctgactccagtggcacctgggggcctggcctcactgacgggagaacattggcgtgaaggctgctggcgactgggccagcattcattgtgaagaccggagggacacaccctgctgctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaacgtggcgatgagccatggaaataaagaaaccttctcttgccggggaatcaagctggctgttgactggttcagggacagaggacacacctacatcaaagtttttgttccatcctggaggaaggacccaccaagagctgacacccctatcagagagcagcacgtgctggcggagctggagcggcaggcggtgctggtgtacacgccgtcccgcaaggtgcacggcaagcgcctggtctgctacgacgaccgctacatcgtgaaggtggcctacgagcaggacggcgtcatcgtctccaacgacaactaccgggacctgcagagcgagaaccccgagtggaagtggttcatcgagcagaggctgctcatgttctccttcgtcaacgaccggttcatgccgcctgatgaccccctgggccgccatggaccctccctgagcaacttcctgagcaggaagccgaagcccccagagccatcctggcagcattgtccttatggcaagaaatgcacctatggcatcaagtgcaagttctaccacccggagaggccgcaccacgcgcaactggcggtggccgacgagctccgcgccaagacaggggcccggcctggcgcgggcgccgaggagcagcggccaccgagagccccgggcggctccgcaggagcccgggcggccccccgggaaccatttgcgcacagcctcccgccggcgcgggggtccccggacctggccgccctgcgagggagcttctctcggctggccttcagcgacgacctggggcccctggggccgcctctcccggtccccgcctgcagcctcacgccccgactgggcgggcccgactgggtgtccgcgggcggccgggtgccaggcccgctcagcctccctagcccggagagccagttctccccgggcgacctcccgcctccgcccggcctgcagctccagccgcggggcgaacaccgccctagggacctgcacggcgacttgctttccccgcgcaggccacccgacgacccgtgggcccgtccaccccgctccgaccgcttccctgggcgctccgtctgggcggagccggcctggggcgacggcgccactgggggactttcagtgtacgcgaccgaggacgacgagggggacgcgcgcgcccgggctcgcatcgcgctctacagcgtcttcccgcgtgaccaggtggaccgcgtgatggccgcgttcccggagctctcagacctcgccaggctcatcctcctggtacagagatgccagagcgcgggggcgcccctgggcaagccctaagggaccaacacgcacttgcagggaatggcccagcctcgccttgcgtcttggacgggtggacctgtggttgccagcctggacctgagtgggcccatcatggtgcccccttttctttaaagatggtcagggaagcctgcttcctcctcctgagcggggttgtgggggcctggtggcacttggtgatcctcactgaggccggggcctgctgcggggaggtccacccacttccgtggagggaatgattttccatgtgcacggagactgcgggtccaagctgcagtagaacccacaagtgggtcacaaaatcaatttagtgggtcaccaccacaaacacagtggactgggacagggcaaagcgcaccctgtgccatcaggctgagtctgaactcttgttacctatcctgtgtccccacccccttggcagccatgtaactaacctcaatgtgggtcgtagtcagaagtttaaaaaagactatgaatgctcttgaatttcattgcttcaggtaatgtttgaaatatgtagtcaggtggccaggggaggtttgctatctggaagttttcatgttagctattgctaaccccacccgcaagggcagcccagcctccaggtgtgggctctcctgtgctctgaattgtgtggctgtcctatgctggggacaagtggtaggagcgctttgtcccagggccaccttctggggccttcacacacatacccccaccacacaaacacacacacacacacacacacacacacacagtctatcatacatgtacatactcacacacaccacacagacacatactgtttggctaagggttaagtatctccaatattttattagccatccatcatggcagtttccagaataggctttctactgtaccagctgagctgccttcttttacttcttcttcttcttctttttttaaacagacagagtctcggcccggcatggtggctcatgcctgtaatcccagcactttggaaggctgaggcaggcagatcacttgaggtcaggagttcgagaccagcctggccaacatggtgaaaccctgtctctactaaaaatacaaaaatttagccaggcatggtggcatacacctgtagtcccagctactcaggaggctgaggcaggagaatcacttgaacctgggaggcggaggttgcagtgagttgagatcatgccactgcactccagcctgggcagcagagcgagactccgtcttaaaaaaaaaaaaaagacagagtctcactctgtcactctgtctggagtatagtagtgtgatcatagctcactgcagcctcaaactcctggattcaagtgatccccctgcctcagcctcctgagtaactgggactgtaaacatgacagccgcacttcacagttacactggggctggatgagtcaggacttttgctctcaaatctacaggtgggttaggagaaaactgacatgagctcagtcagagtttattgccaccttcctggtgccgtttcttctagccagctactgctctgggtttgaggagaaagggcctactcatttgcaatggctaagaagtgagatggtgctgccagagtgccgacccccgaatcctcaggggccctggcctctcctggcagcatccacccattctggttaccatgccagccctccagactatggctcatttgttcactagagggcttggtagcttggcagtttggggaaagcgggaggcacttcccaggggaagaccagagaagaccagcccccagccccacaaacttcctgcagcctgctggtgcagagggaactcttgccagtttactaccagatttcatgagatgttggcaggcctggggggcacctcagggagagtgcgttcccagccctttcattcatggtaaatgacacccctggggcatacagtgatgttaggtttttctctgaaacttctttgatcttttaaaaccagattcttagcatggattgagccagatctgttccttaccccctttttccaaagaggacggtgcacccacaattttaccataacatattgggatctcaggcctgaagatgacccattctttgtaaataagttggattttcctcataatatgtgtgggtttttttggtgggggaggagggggcagggttccgctctgtcatctgtcacccaggctggagtgcagtagtgcaatcagggctcactgcagctttgacttcccaggctcaagcaatccttgtgcctcagcctcctgagtagctgggactacagttgtgccaccacgtccagctaattttttctattttttgtaaagacccaaagcgttgggattacaggcatgagccacctcaacgggcctttattttttttattttaatttttattattattatttttgaaacggagtctcgctctgtcacccaggctggagtgcagtggcgcaatcttggctcactacatgctccactgcctcccaggttcatgccattctcctgcctcagcctcccaagtagctgggactacaggcgcccgccaccacatctggctaactttttgtatttttagtagagatggggtttcaccgtgttagccaggatggtctcgatctcctgaccttgtgatccccgcctcagcctcccaaagtgctgggattataggcgtgagccaccgcgcctggccccgggcctttatttttatttttaaccttttgacaagacacgctttctattagagctgctttttgtctccctggttcgatttcctgatgtagaatcattgtgttgctgatttttcagttgaaaatgtttaaactgcttcctttgagaacaagtttgagttttagtaagctgtaaagctgttttatttgattcactgtgaataagacaagtacaaaaaaaaaagtgaaaacacagcacatttcaagtgtaatcccctttggaatttttccaaagtcttagtatatgtctttgtgacagaaaaacatagatgggacaggtaaatgaaatgttcctagttgcatagctgttaaccatgcttcaaaaataaatcattttttaccacacctggattctttattgtcaaattgtctattagtttctcctactggctttcccctagattggtctgttctgttaaaaattgtgggtttagactgggcacgatggctcatgtctgtaatcccagcactttggtgggcttcatgagttcaggagttcgagaccagcctggtcaacctggtgagaccctgtctctactaaaaatacaaaaattagctgggtccgtggtggggcacacctgtaatcccagttgctcgggaggctgaggcaggagaatcaccttgaacccaggaggcagaggttgtagtgagctgagactgtgccactgcgctctgcactccagcctgagcgacagagtgagactctgtctcaaaaaacaaaaaaaagtaggcgtgaagaagactgaggttgtggccagtctcagcagccgcagttctgtgttgttccacctggggggatgtgaggggctcaaatccaccttttccaggagaagcagtgaggccatggcaaggacctccctttgctggatgtgcagcaggcagttcccaaggacacaggctgcttgcccatttcctagacttctaaaatcctcattatagaactatgaagccatctcatagaagctgctcttcttgttcaaacatgcagcagagctctcctcgactgatcaaaccagaggctgttgccatcttgggtttgccctgaggcagccttcccagaggcctctggaagggggtttggggtagaactgtagaatgtcaggggttgaggagtagaagcaagacaagccactctaattggcattcttccaaataaaatggatccagctttggtttga

SEQ ID NO: 201285 - DNA, 753 bp, Homo sapiens
  Payload ID: 19728
  Gene Name: zinc finger CCCH-type containing 12D
  ENST ID: ENST00000409948
  CDS Start-End: 154-657
tcaggacaagacaactttctcctcaccatggtggctgagttctggaggctgtaatttcgtggatttctgtggagctggcagagctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaacgtggcgatgagccatggaaataaagaaaccttctcttgccggggaatcaagctggctgttgactggttcagggacagaggacacacctacatcaaagtttttgttccatcctggaggaaggacccaccaagagctgacacccctatcagagggatagggatgggaaatgagtggaggtccattctcctgggagcagctgccagggagtagctcagctcacctgttagtcatcccgattttgcccgacttccactccatctccaccaccagaagtgctccaagactgcagggcaatggctcccacct

SEQ ID NO: 201286 - DNA, 810 bp, Homo sapiens
  Payload ID: 19728
  Gene Name: zinc finger CCCH-type containing 12D
  ENST ID: ENST00000458251
  CDS Start-End: 1-319
ggcggtgctggtgtacacgccgtcccgcaaggtgcacggcaagcgcctggtctgctacgacgaccgctacatcgtgaaggtggcctacgagcaggacggcgtcatcgtctccaacgacaactaccgggacctgcagagcgagaaccccgagtggaagtggttcatcgagcagaggctgctcatgttctccttcgtcaacgaccggttcatgccgcctgatgaccccctgggccgccatggaccctccctgagcaacttcctgagcaggaagccgaagcccccagagccatcctggcagcattgtccttatggtgggtagggcccagtgcttcgcaggccctgttcagggccttgtgtgggggcagtacaggagcacagtcaaaaagcgctggcctggtgctcagcggcctgggctcttgcccaagttctgccctccagctgtgctacctggagagttaactttcctgacagggttattgtagaactgacatcctggccggtgatttcatgggagccaggatcccatgccagggtcggatgcaggggtcatgcacacagcaaagctgtgtctgagaagccgggagcctggacacaaacccagctgcgggtctcagtcccttcacctggcccctggcagcttctgtcctcaccctaccctgctctccacccctccaccctatggactttggtcactgctatccatgaagagttaagaattttatcccagcaccctgggggatgccagccttctagccagctctttcactgacttgcttcgtcaagttatttgatgtttccaagttcagtaaa

SEQ ID NO: 201287 - DNA, 8018 bp, Homo sapiens
  Payload ID: 19729
  Gene Name: zinc finger CCCH-type containing 13
  Uniprot ID: Q5T200
  ENST ID: ENST00000242848
  CDS Start-End: 350-5356
aaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgttgtctttcagtttgaaatctttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 201288 - DNA, 6412 bp, Homo sapiens
  Payload ID: 19729
  Gene Name: zinc finger CCCH-type containing 13
  Uniprot ID: Q5T200
  ENST ID: ENST00000282007
  CDS Start-End: 72-4766
agaggaacagggcaaacctctgacttccggcggcattttgaggcggtcctcctagcggcctgtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaaggtagtttcattttactttaactatataatgtctgttaaccatttaagatgccatctgaaggggattctgatctgttcttatgtagcacttaacactgtgtagaaactattttttgagaaatcattttataatcattatttaaccctcatggtcaaagtttctctttaaaatttattttgagaagaagagttatcccacagaaaagttgggaaaagagtacaatgacctttttgtatgaaaattacttattaacaggccaggcgtggtgttgcatgtctgtagtcacagctactcagggaggttgaggcagcaggattgctggagcccaggaaattgaggctgcagtgagccatgattgagccaccacactccaacctaggtgacagagcaagaccctgtctcaaaaaaaaaaaaacaaattaaccaataagttctaatatcaaagtgctcagtggtttgcccttggctaaatgaagcagagccaggaaaaacagactacatatttttcatgtctaaagaaattgggtattttggcagccctttcccctagacatctacccaaatgcaggtgtgtaggttgagtctttaacaaagtgattaagagcttggtctgtaaggccggatgatctggatttcagtaggcacaccacttactggctattacttaatctgtgtgttagtgtcatcatctgtaagtcaggaataatcataccaccaacttcctatggtaattaggagcaaatgagttattacaggcaaaacacttagaacagttcctggcatatagtaatacccaataaatattaactgctactttgaaaatatcctatcacgctgatttttgacctcactgcagcaattttcagttattccagattatctagcttatggattctggtggtaggggttgtttggttttggttttcactgtctctgtctcatctagtacctaccttagtttattttgcaacttactaatactttattaatggggagggacgagtagatggtaaaaagaaggaaaaggaggtaaaaggtgaaaggaacaacattaattaacaattttacgtcatgtccctggacataaaagtttagttagtattaaatttttcactaatacaaaataaaaaaatattgttttatgagttttatgaattcatgcccttcctttactctattagcataagcagtaaatttttttattttaatatagcccaataaacctagagtatacatgtacaaaatacatataattgttaacgtgtattaaccgaaaaatgacccaagacttagttcttgccctactgtatctgccttgtttggttggttctgtgaccttaagcaaataactcctgtgagcctcaattttatttgtaaagtgatggaataaaacccctaaaatcttacccacctctaaagatatttgtttctgtgaccttttgctagtagcatttcaagttaaaatctggtttgattttgctacccatgaaatacagttcggcccttacttattgatgacttaacctaaacagtgaaaatatgcactgtaaagggtggggtgatgtggcttaacaatcagacttcttctatttttgctgctatggtggttgtattagagaactgatgtattatcttgaataaagactttgtcttgtttactgccata

SEQ ID NO: 201289 - DNA, 695 bp, Homo sapiens
  Payload ID: 19729
  Gene Name: zinc finger CCCH-type containing 13
  ENST ID: ENST00000428921
  CDS Start-End: 350-695
ttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaacagtgataacgatttaggtcctgggaattgagtgctactttatcttcacaagccttagtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttagggtaggat

SEQ ID NO: 201290 - DNA, 535 bp, Homo sapiens
  Payload ID: 19729
  Gene Name: zinc finger CCCH-type containing 13
  ENST ID: ENST00000464597
  CDS Start-End: 1-350
gtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagaggtcagtagggtgataaatagtatcgagaaaatagctttttctgaagtgatactaaaaagaattagtaggttataaaagggtacttttagtacattttatatttaatgtaagcttttttgttctaaaaagaaatttgaaatgtttcaattaaaaagacaattatagagaacaataaaacaaacatctgtgtaacatcca

SEQ ID NO: 201291 - DNA, 18281 bp, Homo sapiens
  Payload ID: 19730
  Gene Name: zinc finger CCCH-type containing 14
  Uniprot ID: Q6PJT7
  ENST ID: ENST00000251038
  CDS Start-End: 226-2436
tgagcacaggtttcgcgggtagaaggcgtgcgcaggcgcggacacgggcgcatgcgcgttcactccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctgattgttttttgctatttaatagccactgcccagacacatatttaagagtttaatctttcagttgctatggcttatgaacaagctaaggttgaccataaaacatttgttggatgacgtggtttaaaatgatcaccacaaaaagggaccacaaaaaaaggaaggaaatgagcatggttggcgattggaagcaagggtaccagagggcacagtgtgctttggcatgcattttatacataaaatgaatggaacaaaaggtgccagaagtcccaggttacacaatcaggagcttagatactgcacacaaaaataattatctgggttaaaaaagtaaacatagggcagattctatatggcctatcatgtttcttcaccttcccctcgttgctggctgatacagcgaggtggtcagctgatgactacttagtcaatatgacctttagtcgtgaaactgacagcagcagtgattaaggctgacttaatcaggttggccactttgaaggacagaaatgcagtggaaacagttttattctatgtagtttacatgcttaaggttacagagtttctacctgcactgtaatggaaatataatttctctgtagccaaaagctggcaaacttgacccagagggaaaatttaaaactgcagcaggctcaaatgtagagtatttttctttttatgggcaggttgttcagggatttttttcctcctttaatttattgactgactgtaaatacatgagtagaaacttaatagtcatgtatttcaaaatttggcttaatttaggagaatccactgatgaacaagtaccaacttacgtttcaagcttcttagccccataatcagtccttcagccacagctatttagagctttaaaactaccaggttcaatcactggttatgctttctgtgatgtaatttagtcatttctatttttagtattaaccaagtattagacacagaaaataggtattaagaatcttcatatatcctgtcagaccaaatgggattccaggaacctaaagcgatctattatgctataaagataattaacacattaaaaactcatagggtcaatacagcatcttaaacctcacacttagaaaaatatatttttaaatagcagtctacataattttcaatcttcaggaaactacagataggctagacagcgaattcctgaatgatgagtagtgatctttggcagcatttaaagtgaaaagaaataaggatctaagaattcagccctaatccactaaaaaaaggaattctaactgacaagtttttacaaatggagttgggctcattcattttggaaataaacctatggagtggcacacatctaaacaaattttcccaatagaaaaaaggctataaaaattttattccaagagtgattaaattgtataatgttgtatatgtgaatttaacacttttgtttacatgttaaacaaatgtgtatatattagactacattaaatatgcaattctttcttccagttaaatactgttgctccctaaaacccttacattgtacaccattgggaatgattgttcatcatactacttttccattagtgaggctacagttatgttttaaatgtgcgattacagagatggcatctgaacataaactgatggctcgaaaatgaaaatggaaatgtagcagccatatactgctaactttggatctgttcctgaattcaaaactactaggagaaaagtgtcctttataaaaaaggaccttattaatgcctaaaaaacatcatattctctaggaaagcttgtgtctgtttccttagggaaaatgtttgccttttaaaaactgtgatcctttaggatgatcatgactttccctttccttatggaaatgcaagaataaaatatttcattaaacaatgaaccttgaaaataaaatataaacattaagaaaccattttgctaaaaagataatgaaaattatccaaattgggtttttgagttcttctgtaaagagtgctctaccctaaattttcccagcaggtctgccgaaatcacacacttcccaatacagggggacttggcctttaccatcaagtattcgatccttccttgaaatggcattatctggcagtgtatggattacggattatacccagtgcatatagcaaatattttgaacagatcagtctttcactattttgatgattctgggcatttctccctgttacagtcttgggttagcaccacttgaccatgcagggttgggttttggtttttcttctctgtaattctggtctcaaagttaatttctgtagtcatctcagcatctctcagtgaggtgtatgtacacatttccagacaaataagctgcaatcagagaagaaaattgcagggagttaattatgtttttagattttcataacagtttaatatttttcagttgtgctttcaggttacatgtgtaatatttttcctctttaactccttttattctgtatttgcataaatatgagattctgaagagccatctggttatactaccttctactaatgttgactagctgatttcataaaccaaagctgtaggagttgttgtattaagtctcttaactagtaacatagtctgctcttcatgggctgagaaagttactaacctgcagtcatcacctccagcactaacaacatgtcgatcaccactggtaaatcgaatatttgtcacatggggcgaatgacccaagaaccttttgtgttttgcctaaaaaacaatgacagacaagctcagggcatttggtgcacacagaagtcaaaggctcttattaggaactataatctctatgacaagagctgtggagagagtagggagttagcaccgcagccagtgattagaatgcttttcagcatgagtagtggatctgcaaaaccaggctgtgtgggcagtcagatgtctccaggtactctgaccatttttctctaaggaaaagcatttgaaatttgataactgattataggtttggtgaaaagctaattacagcttttgtaggatggttccaaagatggtattactcgagggagaggatttgtttctaatagcttttatttcaaagtaaatagatttagaaagtttggggaaaaatttagaaattaggacaaaacattttaaatatatggggaaaagtgctgatgataagacatcaaaattaggagtaaactgataatagtaaacaaaacacaaacttacaaatttttctggacatgggaagtcaaataacttaaccatgccaaagtcatctcctgtaacaagactgattcctgaatgagatacacaggcacagttgacatcagctttctcagcatgtctggaccagattcccaaaacctcatctcctagaatactagagggaaggaacaaaagaaaactcatcatggcaagtgcgggcaggttgactatattcaaaaagtttcttggcaattaatctctaagtaccctatcatgttacttaaaatacaggaagtaaattatggtaagttgtttggagacctgaatttcatcaggatatcaactcctgccttttaaaaatgacattttataatttgaagggtttctagattaatctttttaagattaaagtagtactttatgaaaactgatagaactattttttctttttttttttttgagacggagttttcgctcttgttacccaggctggagtgcaatggcatgatctcggctcaccgcaacctctgcctcctgggttcaagcaattctcctgcctcagcctcccgagtagctgggatcacaggcatgcgctaacatgcccggcttattttgtatttttagtagagacagggtttctccatgttggtcaggctagtctcgaactcccgacctcaggtgatcacccccgctcggcctcccaaagtgctgggattacaggctgagccaccgcgcctgactgaaaactgatagaactatttttcaaattaaaagtgctacttggctgggtccagcagcacataccagtaatcccaacattttgggaggctgaggcaggaggactgcttgaggccaagagtttgagaccagcctgggcaatattgtgagatccctatctctacaaaaataaaaatgacttatgacataggaattaaaaaaatttcagagatggggtcttgctatgttgcccaggctggtatcaaaacttctaggctcaagtgatcctcccacctcggcctgctacatcagagattacaggcatgagccactatatgcctggctgatacaggaatttgatggcatttttcattggccaaaaaaatggatagtcatggttacctgtcatacagccaggaaatttgaacaaatttggaagctttgacttctaatagattcaagatagcattcctttagatagagaattaataacagttgcttaacagcacccaatacctttttgccagtcattaaatttagcattaagaaaaatatcagggtatctttaaagttaaaactttgatttccttaaaaaaaaaacttgataaatcatggaaactgataaaacatggaaatatattcaataaaaaggggtcccaacatgaacataccatttcaaaatatggtaacaaaaacttgaaactcaattactattccttattggaatggctctaacagttcagaaataggattttctaactggccttcaaagtcagttcttgccttgtgaatatataagtatttacctagtccatgtagcccaagtaattctgtcaatagcggcatgatccataagatgttttcctgaaggcacttcatagacatgccgtttatagcagccactagagacctttttcatcagattaaaatgggacaagaattccattaggtgagagacaaaatccacagggggtttacagaatactagcatattgctacttgatttacatgtctaacattattaagtatgcaaaagatcactacaaaaacttaataggagaaaagctctgataagtgggggaggaaaggggagctgtaggtcagaaggtacaaagggaggagttgagaagctggagctctggagctcaggaactttaaatgcattcactaacacgaaatgtaaaagcagaagaacttgccacctgggtatacagtattggtactgtacctggagataactgctatctgcagagaagtccatttgaatgacaaagcttggaatgtctttgcagtagctgattctgttaagagtggggcccagcgttaggtcataaaaatccactgagttctcactagaacctactgccagataccgggaatccggactaaatctgaatcaaaacaaaacgtaaaaagtattagaccacatgaagtattataaatacttaagatcagtgacttttcctttctagttcttaaaagtaacgtgtgataaggcctcaaatagatttacctgtcagacacaactgatcatgtatactgagattgtctgggttacatgaaataaggaagctttatattttacttaaattttaaatatttccccaattgtcatctcccaattcctttaaaaacgtctaatggcttaaaaaaactttcttaggccaggcccagtggctcacacctataatcccagaactttgggaagcggaggcgggcagatcacctgaggtcgagagtttgagaccagcctgaccaacatagagaaaccctgtctctactaaaaatacaaaattagccaggcatggtggtgcacgcctgtaatcccatctactcgggaggctgaagcaggagaatcgcttgaacccaggaggcacaggttgtggtgagctgagattgcaccattgcacttcagcatgggcaacaagagcaaaactccaactcaaaacaaaacaaaacaaaatttaattttttaaatagaggcggggtctcactatggtcccaaactcctggcctcaagcaatccttcccccttggcctcccaaggtactgggattacaggtgtgagccacaacacccagtcagaacatctcagcttttaaaagccattagcattacataattaataagctaacaattcattaagatagttttcttccatctggaaaaaacgttgtcttaatattaagcaaagaacacagcccagcttaactaacctccagttattaaggtgaaatgacacaacttgaatcttggaagaagaattttttttttttgagacgaagtctcgctcttgtctcccaggctggagtgcgatggcgcaacctccgcctcccgggttcaagcgattctcctgtttcagccccctgagtagctgggattacaggcgcctgccaccacgcccggctgatttttgtatttttagttgagatggggtttcactatgttggccaggctggtcgagtactcctgacttcaggtgatctgcctgcctcggcctcccaaagtgctgggattacaggcatgagccaccgcgcccggcctgaagaacttatttaaaagacaaagtgaaatgctatttgcctagcaatctttggagtcatatgggacaattcagtctcttgaaatggcccatgagtcttactgaggtacgatagagacatgtaaaagctaagggaagccactgttactattttatatattgaagttctgaggaaggtttcatttgtaaaaggattttactgatgaaaagtgtacaagcttttgacagacctagattcaataatcttatctactgatcacacggaagtactccgtaaatggtagccactgttgaaaaatgcttaagcactgaaaaacaaaggtttaagaaacatttaaattaatttggattctggaacatttaatcaataggtattgattaaattaatgaactacatattcccaaactgaggttactaagagaagatatgtttgaaatcacaactttagttttccagggtgacaacttttgaagggcagatagctctcttgtattacagtgggagatacctcttggtgggatgaacttaatggacatggctaagtgttaacatgaattcatcaaacattacctactagtacttgctattatagttggtgcccagtgggtttataatttagcaagaagaattaagtagtatacaaacagccatattttagcatacaatttataatacgggaaatgctacaggccctggggacctctttttgaaggcaaggctatggaaaattttacaaatggaagttaaatcaagtatatactagaaactctattccatttgttcactaacctgatatcatggattgcacatctcctgtctctcttctttccccatatttttagagaactcactagtaaaatgataaattctccatttttcattccaatagccaccatgtccccttcagggctgtaacacacagtacgagcagcatgtcccaaattcactttgtttaacatcttctgcatttaaaaaaaaaaaaaaaaagagtcataggaaacattaagtgaagtacttctaaattataccagtttcccctcaaaatgctcaacagaattctggcagttctttaagtactagcaatttagaacttccaacttttctttttagaagttgtaacctcttttaaaaaaattatctgtacttactttatcagcaatatcccaaagtctcactgtcccatcttctgcagcagaaaggaaaaaatccctggaaggatgtgttgctagtccccagattggcccatccacatgaccgttaactaaaatattacaagctgcatttttctctccaacttcgattatttcagcattccttgtcccaacaaggatcttgccctgaaacacaagcaggaccaatacagtgaatgtaatacaacagctgcttttcttcttcataatataaaaatgaccctattgacctgctttcagagaactttttgctttgagctaatctagtagcaaggcagtcattagctcatgcaaatttttctatgactacaggcacacatctatctgtaagcacaatgggctagattacatattagagtccatgctacagaatagaacttttctgtggcagtacacctggattcttcaataatcaaagtttttatttgataatcttaggatttccaaactggggtcagtgcagtgggatataggaaaaaataatagaatttattttttagttaaaaagtaaaagcttaactacaatttaatatgcaggctgaagataatatccgtatgatttataaatacacttaataagtacaaacacgctcaaaaattttcataggagttgtagttttgaatttttattttgaaattgacacataattatacatatctatagggcatagggtaatacgcataaccatcacctcagacatttatcatttctttgtgatggaaactttcaaaatcctctcttgtaaatacctgaaaatacataaatacgtgattcttaactatagtcatcctacagtactacagaatactaaaacatactattcctatctggctgtgtaaacttgtatcctttaaccagtccttccctatccccctccccctcccccttgtccgcctccagtaaccactattctactctccacctctgtgggatcaacttttttagtttctgcacaggagtgagaacatgtatttatctttctgtgcctggcttatttcacttcacatcatgtcctccagtctcatccatgttgccaccaagaatgacagaatttcattattttttatggctgagtagtatttcattgtttgtttactgcacgttttatctagggaatgtgtgtttttttaaaaaatggagacagctgtcctaatatgagtcaactgccaagggctttcaattatgtctactagagttgttaaattggcagattctagaaaatattggaggtttacatacagtatttagacagaatagcttcctagcttatgcaccacactggtgctaactttggcaaagaaagcagcaaagacagagtaatgttggcaagcaaatccatcgttatgcattattaagtattgttcattaggctgcaaagggtgagggaatcacagtaataaccactttctgttttctgctgcactgtatcagctcatggaacatcttactttgcctctgcacacagaacgaacacaatctgtggcttgtcctgtctcaagcctgaaggcacggcaccgcctcagttcctgatcccacagtttaaccgctcctccttcttttgacctaagtaaataaccaagccagagtaagtgttcattattggctactataatttttattataaacaaataccaagttataagcagaatcttttttttttaaaaaggccctgatatttataatttacctctaatattcttgtaaactttctatggcaatttgaggatatactatatctcagtcaaaataaacatccagtttcagtgaattttattttgagaaatactctttttttctgacatgagcataattttatttagcctctacaatacattacaatacattatcctctctcataatacttttttttttttttttaagatgtagtctcgctctgtctcccaggcttgagtgcagtggcatgatctaggcttattgcaacctctgcctcccaggttcaagcgattctcctacctcagcctcccgagtagctagcattacaggtgtgcaccaccacacccagctaatttctgtatttttagtagagatggggtttcaccatgttggccaggctggtctcaaataccttgacctcaggtgatctgcctgcctcggcctcccaaagtgctgggattccaggtatgagccactgtgcctggcctcataatacttcttgattaggaagatgtaaaaaaacaattttattaaaaggataatggaaatgtaaggcaaaataatagaattacaaatgctatgctacagagttgatttatttatttttttgagacagagtgtcgctctgtcacctggcctggagtgcagtggtgtgatctcggctcactgcaacctgtgcctcccaggttcaagcgattcttctccttcagcctcccaagtagctgggattacaggcaccatgcctggctaatttttgtatttttagtagagatggagtttcaccatattggccaggctgatcccaaactcctgacctcgtgatccgcccacctcggcctcccaaagtgttgggattacaggcgtgagccactgcaactggcccagagcttatttttgaaggccaaaacagaagcatatttattccctatcaggtgttaaaatatctcactggaacagtttagcaggcttctagtgagtgggggtgtgcaggagtaaatgacgtgggaaatacaagtgttggaggacgaaatagagcccatttatggattttattcctggaagggctgaaaaatgtattccttccttttctgctagatgaattgcttgtctgaaagcatgcctatgtgcattcttcctttatgtaaaaggcacaaattctgcgcttgtgtttaattaacatatgtgggttctttcaatcctgtattgaaatgtacttcttagtcaactatatgtcacatttttttttgtttttgtttttgttttttaaatggggtctcactctgtcacccaggctggagtgcagtggcaccatcacagctcactaaagccttgacctccccaggctcaagtgatcctcccacctcagcctcctgagtagcagggactacaggcatgtgccaccacacccggctaattgttgttttttatagcgatggggtttcaccatgttgcccaggctggtcttgaactcctgggctcaagcgatccacctgcctcagcctcccaaagtgataagattacaggtgtgagccactgtgcctggcctacatgtcatgtttcaacatgcatatgactatgttggtgacaaatcaaatcataagtatctggttactgttgggagatttgaaaatcactcagaagagacctcttctcaaattttgaggtcttgtataaaacagtttaaatttgcctcaagcaaaaggaaacaaggcagttctctctagttccctcatccttttctaaagcaacaatgtgcattctactccttagaatccattctgaacaaaaagagagcaggcagtcaaaatacaaccctggctccagattcccccatgggcctcctactcagcaaatcatacacaggcatacagacattaagaaaagtaactcaacttgtaggacaactacctatccacacctcagaaaaagtatcaccccaacatgaaaaaaattggaagtgaattaagaccagaaatgagaatcaaatagaaggcacataaaaggtaataaaggagaagcatatgaggaggaaggtcggagaggacactctgtgtagcctagaaacaactagaataattaactgcaaacctcaggtaggtcacaaatgcataaatattctgtgaaaagaaagaggactcacggcctttcctttcccccagtcacgataagtccatctcgcagggtggtgtacatggcaaacacaggcccgttgtgagctctcgccacgattctacacaatatgtgatctttccacacacagacatcaccactgatggtacctgtaaacgtcaagttattctgaaaaggagtgggggagggggagacaaactcatcaaaagttcaaatagagtttaaatagataattttctatgtatgtgtaatgctgtctcacccttgatacaaagagcatgcatcgtgtagtggcagcagcactgaattcacgagtcaggaaacctgaacgggaggcttagctttgtcaggaccttttcctttccaagtctgttgcttattagctagaataaccttagacaattcttcccttccaattctaacatactataattctagggtttattttttatttttttgagacggagtttcgctctttgttgcccaggctggagtgcaatggtgcgatctcagctcaccacaacctctgcttcccaggttcaagtgattctcctgtctcagcctcccaagtagctgggattacaagcgccagccaccacgcccggctaatttttgtatttttagtagagacagagtttcaccttgttagccaggctggtcttgaactcctgacttcaggtgatcttcccgccttggcctccctaagtgctgggattataggtgtgagccactgtgcccggcctgagccacggtgcctggcctggtcttatattaagaatacccaaaatgttcaactgaaatttgacatggcacaaacatttcaatagtctttttctcaaaaatgtaagtgtacttaaatattctaaaattataacttttcctataagtattgcataatcacaaaaacaaaaaatgcacttagtttttcgatgcaccaaaggatttatacagcctagccaatgcaggatattaaaggaaagagatgtggattggaagccacaggtccagatgagatggaataaagtgagaggagagcaggtctcctgaacacccttctgtcagggccaggaattgtgctatttccttctgtctcactacctccttcttccctcgaagtagagacactggcccagagcacttccagctgtatgataagcagtgtgttaaatgataaaaagcaaaggaaatcctaaaccctagtaccaccttaaatcatttgaaaatcatgtttcttgatttacctttctctctgacaaatttttaggactatgaagaactactaggaagacagaaattttaggatatttagggtgacaattagaagattaaggaaggcttttgagtataacagtagtccaaggaatcaaatgttcatcagaatccttattatggtggctcatgcctgtaaacccagcactttgggaggtcaagatgggaggatcacatagcttaggagcttgagaccacctaggcaacatagcgaaaccctgtctctactaaaaatgaaagaaaaattagcctagcatggtggttcctgccctgtagtcccagctactaaggaggctgaggatcacttgaacctgggagatggaggctacagtgagctataatcgcaccattgcaccccagcccaggcgacagagtgagatactgtgtcaaaaaaaaaaaaaaatccttttccccctctcattaacattcttttcactccctaatttctgaaagaactagatttttgaaagatgaaatatatgcttgaccagggcatgtaatgattagcagatcacagtatcatctcaacaacattcatgtggctgatgatctaaggcaagagaatgtaaagtagtcaaagtcacactatgtgcattttaagagacatactgcaccaaatgcaatagcgagcatggtctgcatccgggcatcttccagtgtgctcagtagcccttttttgctaagaagagctcttcctgccagggtccagaacttcacatgttttactcccactgagacaaactgggtatctgaatctggtcggaattctgccacaaaaatacgttgattgtgaccagctctgctggcaattttggcacctgacaagatacaacaaaattatctaggttattacaagaaccaagctaatcaacagcatcaaacaaatatgtaaaatacatagttcaaaaaacaaaggcttagaagagaggccaatggcccctgctctactacctagcaatacatgatttacaattatttgtgtattgagtccttttcacttatcttcgctccattaacttttctttatataacgtaaatgttttgtctaaagtgtggtaggtaatattatcctgctgatctgccattatcattagaaatatacataattttcataagaatctccaaaaccaatcaaatcattaataataaatacatagtttcttgctggaagaaaatagcagtgaatcatttataatgctaataatggtttcattaatttatctgttttgtgaggttacagttccactgggcttttaaagtgaaatatacctacagtaccactgtgtacagtatattgcataggcctccactgaatgattgtttcaaccaccaactttaagacaaatattaaatacagaattcctacta

SEQ ID NO: 201292 - DNA, 2560 bp, Homo sapiens
  Payload ID: 19730
  Gene Name: zinc finger CCCH-type containing 14
  Uniprot ID: Q6PJT7
  ENST ID: ENST00000302216
  CDS Start-End: 165-1904
actccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaag

SEQ ID NO: 201293 - DNA, 1384 bp, Homo sapiens
  Payload ID: 19730
  Gene Name: zinc finger CCCH-type containing 14
  Uniprot ID: Q6PJT7
  ENST ID: ENST00000318308
  CDS Start-End: 329-1249
gggtttactggaagaggagctatacagatggtacttagaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatc

SEQ ID NO: 201294 - DNA, 2007 bp, Homo sapiens
  Payload ID: 19730
  Gene Name: zinc finger CCCH-type containing 14
  Uniprot ID: Q6PJT7
  ENST ID: ENST00000336693
  CDS Start-End: 176-1891
cggagcgtggctgcggctgaagtagccgccgggaaatggaaggacaggcgcaggcccggctggagccaccaccgcggcgcacggcgccgctttggatccgctgcgggagagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataata

SEQ ID NO: 201295 - DNA, 2195 bp, Homo sapiens
  Payload ID: 19730
  Gene Name: zinc finger CCCH-type containing 14
  Uniprot ID: Q6PJT7
  ENST ID: ENST00000393514
  CDS Start-End: 1-2136
atggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaa

SEQ ID NO: 201296 - DNA, 1341 bp, Homo sapiens
  Payload ID: 19730
  Gene Name: zinc finger CCCH-type containing 14
  Uniprot ID: Q6PJT7
  ENST ID: ENST00000406216
  CDS Start-End: 293-1141
agaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgttttt

SEQ ID NO: 201297 - DNA, 580 bp, Homo sapiens
  Payload ID: 19730
  Gene Name: zinc finger CCCH-type containing 14
  ENST ID: ENST00000555120
  CDS Start-End: 298-580
ttttcctagagccgcctttctcacatgcacgtttgctctttttctctcagagtgccattaaggggaaattacaagaattaggagcttatgttgtatttgaaatacctgtggaatgaagagaaaaaaattaaagctaagccatcttgtccaatgtaattccagtagagctctgcgactctaaagcttagagctacatctatattttcaagcacatcaactttaagaagaaagttttgaggaaacaaagttttgatctacctttccttttaaatagatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagatt

SEQ ID NO: 201298 - DNA, 2075 bp, Homo sapiens
  Payload ID: 19730
  Gene Name: zinc finger CCCH-type containing 14
  ENST ID: ENST00000556945
  CDS Start-End: 125-1942
gtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgccta

SEQ ID NO: 201299 - DNA, 577 bp, Homo sapiens
  Payload ID: 19730
  Gene Name: zinc finger CCCH-type containing 14
  ENST ID: ENST00000555792
  CDS Start-End: 1-456
cttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagattggagatcagtcctggtttttattttgttagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaag

SEQ ID NO: 201300 - DNA, 577 bp, Homo sapiens
  Payload ID: 19730
  Gene Name: zinc finger CCCH-type containing 14
  ENST ID: ENST00000553495
  CDS Start-End: 127-321
gtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggag

SEQ ID NO: 201301 - DNA, 400 bp, Homo sapiens
  Payload ID: 19730
  Gene Name: zinc finger CCCH-type containing 14
  ENST ID: ENST00000556110
  CDS Start-End: 1-246
gattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagattactatgacatggaatccatggtccatgcagacacaagatcatttattctgaagaagccaaagctgtctgaggaagtagtagtg

SEQ ID NO: 201302 - DNA, 2092 bp, Homo sapiens
  Payload ID: 19730
  Gene Name: zinc finger CCCH-type containing 14
  ENST ID: ENST00000556000
  CDS Start-End: 1-1955
cttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatcta

SEQ ID NO: 201303 - DNA, 849 bp, Homo sapiens
  Payload ID: 19730
  Gene Name: zinc finger CCCH-type containing 14
  ENST ID: ENST00000556158
  CDS Start-End: 221-849
gcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgtatttgaaatacctgtggaatgaagagaaaaaaattaaagctaagccatcttgtccaatatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgc

SEQ ID NO: 201304 - DNA, 813 bp, Homo sapiens
  Payload ID: 19730
  Gene Name: zinc finger CCCH-type containing 14
  ENST ID: ENST00000555799
  CDS Start-End: 168-813
ggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgc

SEQ ID NO: 201305 - DNA, 1762 bp, Homo sapiens
  Payload ID: 19730
  Gene Name: zinc finger CCCH-type containing 14
  ENST ID: ENST00000555900
  CDS Start-End: 313-1629
gagctatacagatggtacttagaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgccta

SEQ ID NO: 201306 - DNA, 652 bp, Homo sapiens
  Payload ID: 19730
  Gene Name: zinc finger CCCH-type containing 14
  ENST ID: ENST00000554602
  CDS Start-End: 436-652
agtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgtatttgaaatacctgtggaatgaagagaaaaaaattaaagctaagccatcttgtccaatgtaattccagtagagctctgcgactctaaagcttagagctacatctatattttcaagcacatcaactttaagaagaaagttttgaggaaacaaagttttgatctacctttccttttaaatagatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatg

SEQ ID NO: 201307 - DNA, 908 bp, Homo sapiens
  Payload ID: 19730
  Gene Name: zinc finger CCCH-type containing 14
  ENST ID: ENST00000557737
  CDS Start-End: 291-908
aggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagcccccca

SEQ ID NO: 201308 - DNA, 593 bp, Homo sapiens
  Payload ID: 19730
  Gene Name: zinc finger CCCH-type containing 14
  ENST ID: ENST00000557693
  CDS Start-End: 196-593
ctcctcccagcccccgcccgggggatccgaggtgcgcgcaccagcaaagtggcctcagccgctgcagagtccggtcttgttttcctagagccgcctttctcacatgcacgtttgctctttttctctcagagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcacc

SEQ ID NO: 201309 - DNA, 1983 bp, Homo sapiens
  Payload ID: 19730
  Gene Name: zinc finger CCCH-type containing 14
  ENST ID: ENST00000557607
  CDS Start-End: 471-1733
gcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgtt

SEQ ID NO: 201310 - DNA, 2529 bp, Homo sapiens
  Payload ID: 19730
  Gene Name: zinc finger CCCH-type containing 14
  Uniprot ID: Q6PJT7
  ENST ID: ENST00000555755
  CDS Start-End: 97-2289
gaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagct

SEQ ID NO: 201311 - DNA, 463 bp, Homo sapiens
  Payload ID: 19730
  Gene Name: zinc finger CCCH-type containing 14
  ENST ID: ENST00000557047
  CDS Start-End: 1-447
atctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggtgatctgtcctttctctctggctgctttcaagatcttctctttgtgtttgatgttctgcagtttcactacgatgtgtctaggcgtggatttccttttatttttcctgtttggtataatgtatggaagcatcccatatatttgaaataaaatgcattatgaaata

SEQ ID NO: 201312 - DNA, 2138 bp, Homo sapiens
  Payload ID: 19731
  Gene Name: zinc finger CCCH-type containing 15
  Uniprot ID: Q8WU90
  ENST ID: ENST00000337859
  CDS Start-End: 228-1508
tgggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaata

SEQ ID NO: 201313 - DNA, 556 bp, Homo sapiens
  Payload ID: 19731
  Gene Name: zinc finger CCCH-type containing 15
  ENST ID: ENST00000437396
  CDS Start-End: 121-345
tcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggacctgacgtataaatgtttggatgaatcctctaatcatattaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatg

SEQ ID NO: 201314 - DNA, 1101 bp, Homo sapiens
  Payload ID: 19731
  Gene Name: zinc finger CCCH-type containing 15
  ENST ID: ENST00000421536
  CDS Start-End: 131-448
aatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggtaagaggaagctttgtgcctcatctccttatgttaattgaaagaaacaatagaaaataccacaacatggttaagagccaccaacatcagagccacagtgcctgggttcaaatccttactccaaccatgggaaattaatctaggcctccaccctcatctaatatggacataatgattatctctacatcatagtttgtgagaattaatcgagttcatgaattagtagttctttatacagcttaggacagtg

SEQ ID NO: 201315 - DNA, 776 bp, Homo sapiens
  Payload ID: 19731
  Gene Name: zinc finger CCCH-type containing 15
  ENST ID: ENST00000445547
  CDS Start-End: 1-216
gttgatgattcagtgagtgtaaatgacatagatttaagcctgtacatcccaagagatgtagatgaaacaggtattactgtagccagtcttgaaagattcagcacatatacttcagataaagatgagggaagacatggtcatgggaagggctttttaggatatggaaaacctaaatgtatctgtagctcagaggaagaggatctgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtga

SEQ ID NO: 201316 - DNA, 3729 bp, Homo sapiens
  Payload ID: 19732
  Gene Name: zinc finger CCCH-type containing 18
  Uniprot ID: Q86VM9
  ENST ID: ENST00000301011
  CDS Start-End: 201-3062
aggactaccgtcgcggcctgatgacgtcgcacaatggccggcccccgcgggtagtggagcccgtttgttccgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcagc

SEQ ID NO: 201317 - DNA, 3211 bp, Homo sapiens
  Payload ID: 19732
  Gene Name: zinc finger CCCH-type containing 18
  ENST ID: ENST00000452588
  CDS Start-End: 179-3112
gacgtcgcacaatggccggcccccgcgggtagtggagcccgtttgttccgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagatgttgtgacaccattatccactcttcttccaccaatatccaattccataccattcagaggccaggttaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattcttttt

SEQ ID NO: 201318 - DNA, 712 bp, Homo sapiens
  Payload ID: 19732
  Gene Name: zinc finger CCCH-type containing 18
  ENST ID: ENST00000567085
  CDS Start-End: 1-712
aggtgaagtgaaggaccccagtgacaggaaggtgaggcctcgtcccacctgccggttcttcatgaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcga

SEQ ID NO: 201319 - DNA, 694 bp, Homo sapiens
  Payload ID: 19732
  Gene Name: zinc finger CCCH-type containing 18
  ENST ID: ENST00000569435
  CDS Start-End: 104-694
ctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggatgatgacctggaagaaggtgaagtgaaggaccccagtgacaggaaggtgaggcctcgtcccacctgccggttcttcatgaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaa

SEQ ID NO: 201320 - DNA, 1068 bp, Homo sapiens
  Payload ID: 19732
  Gene Name: zinc finger CCCH-type containing 18
  ENST ID: ENST00000565583
  CDS Start-End: 1-591
aaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacataggaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttg

SEQ ID NO: 201321 - DNA, 387 bp, Homo sapiens
  Payload ID: 19732
  Gene Name: zinc finger CCCH-type containing 18
  ENST ID: ENST00000564341
  CDS Start-End: 1-228
ccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgattt

SEQ ID NO: 201322 - DNA, 3280 bp, Homo sapiens
  Payload ID: 19733
  Gene Name: zinc finger CCCH-type containing 3
  Uniprot ID: Q8IXZ2
  ENST ID: ENST00000262577
  CDS Start-End: 33-2879
gggggcctggccggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggaaaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcagcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgtaactgg

SEQ ID NO: 201323 - DNA, 546 bp, Homo sapiens
  Payload ID: 19733
  Gene Name: zinc finger CCCH-type containing 3
  ENST ID: ENST00000528401
  CDS Start-End: 1-240
cgcattgtcaagaagacgccggcctcgcctctcagcgccccgcccttccccctgtctctgccctcctggcgggcccggcggctctcactatccagataccactgtccttgcaagggccgcatgaagtttgctgaggtcaccacgcctttccagggagctgagccggatttgctgtgtggtcttcggaggggctgtcccagggcctgggagtggggggatgtctgctgtgagtctctttagacagcagtgacctgaggggtccttgagggcctaggcaggattcctggccagcctgcccctcagtagctggcacagacagagtgggtcctgggccgatgacccagcccaaagggtggcacaggtgcagagggtcgcgggcccgccaaggacagctgcacctggccgcctggcacctctgccggacgagctgaactcggcactccggggccatgaagtcccactaatacttgtttttttgcagctgacatacaaaacaccaatagcttcagctgaaatggatttttaaaagtgtcattttatggagaa

SEQ ID NO: 201324 - DNA, 1593 bp, Homo sapiens
  Payload ID: 19733
  Gene Name: zinc finger CCCH-type containing 3
  ENST ID: ENST00000632165
  CDS Start-End: 33-1593
gggggcctggccggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggaaaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcagcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaag

SEQ ID NO: 201325 - DNA, 6119 bp, Homo sapiens
  Payload ID: 19734
  Gene Name: zinc finger CCCH-type containing 4
  Uniprot ID: Q9UPT8
  ENST ID: ENST00000253048
  CDS Start-End: 39-3950
ctccgactctcggcacctggcctccagctttcggaactatggaggccgcgcccgggacccccccgccgccgccatcagagtcgccgccgccgccatcgccgccgccgccatcaacgccttcgcctcctccgtgttcccccgacgcccgcccggccaccccgcacctcctccaccaccgcctcccgctccctgacgacagggaagatggagagttggaagaaggtgaattggaagatgatggggcagaggagacccaggatacctccggagggcctgagagaagccggaaagaaaagggggagaagcatcacagtgattcggatgaggagaagtcccacaggagactgaagcggaaacggaagaaagagcgggagaaagagaaaaggaggtcgaagaagaggaggaaatccaagcacaaacgccatgcttcttctagcgatgacttctctgacttctcagatgactcggatttcagccccagtgagaaaggtcaccgcaagtacagagagtacagccccccatatgcgccgtcccaccagcagtaccccccatcgcatgccacgcccctgcccaagaaggcatactccaagatggacagcaagagttatggcatgtacgaggactacgagaatgagcagtatggggaatatgagggcgacgaggaggaggacatgggcaaggaggactatgacgacttcaccaaagagctgaaccagtaccggcgtgccaaggagggcagcagccgcggccgaggcagccgaggccggggccggggctacaggggccgaggaagccgtggaggatcgcgaggccgcggcatgggcaggggcagccgaggcaggggcagaggctctatgggaggagaccacccggaggatgaagaggatttctacgaggaagagatggactatggagagagtgaggagccaatgggagacgacgactatgacgagtactccaaggagctgaaccagtaccgccgctccaaggacagccgaggccgagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgacggtggtggtggaagctaccggagtcgtgaccatgacaagccccaccagcagtcggacaagaaaggcaaagtcatttgcaagtacttcgtggaagggcgctgcacctggggagaccactgtaattttagccatgacatcgaactcccaaagaagcgagaactgtgcaagttttacatcactggattttgcgccagagctgagaactgcccttatatgcacggtgatttcccgtgtaagctgtaccacaccactgggaactgcatcaatggtgacgactgcatgttttcccacgaccctctgaccgaagagacgagggagctcttggataagatgttggccgatgatgcagaagcaggtgccgaggatgagaaggaggtggaggaactgaagaagcagggcatcaaccccctgcccaaaccgccccctggtgtgggcctcctgcccacccctcctcggccccctggcccgcaggctccaacctctcccaacggcaggcccatgcagggtggccccccgcccccgccccctccccctcccccaccgcccgggccccctcagatgcccatgccggtgcatgagccactgtccccgcagcagctgcagcagcaggacatgtacaacaagaagatcccctccttgtttgagatcgtggtgcggcccacgggacagctggctgagaagctgggtgtgaggttccctggacccggtggacccccagggccaatgggccctgggcccaacatgggacccccagggccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccagagctgcggctccagccacccttcctagggtggcattcagggcagcacccagggtagggaacttgggggcaaggggaggcaggctgggtgttccttttttcttttctttttcttttgctttccgtctcttttatttttttttaaagtagtactttctttgagatttgtaaattgtatataaccatcttaagttctggtcagtgtggcgggctcaggggctcctgctgagcaaaccgactcatgcccgcaaacctgtgaactttcgccagtgcctggcctcagactctgtgggctctgcgtggccgggccttgctggaggcccagtgggttttctgggcaaagcatggccccttttccccaggacaaagggaacagttggtgtctgggaaggtattgaacgctcctcaccctgtgcccgaagagacccggaaccaagaccatggcagggcctgcgtggaagcaggtccaggcgtttctagaaccctagggtgcaccatcactgtcttttcagtgcaggctgtaacaacccactcaggagacagtgagagtgaaaaggtattaaggaaaaagcccccagcggcactatgggggctccctggcgcatgcctgctcctgtccctggattaccacacgtgccctccctgccaccctccgtctagagcaagcggatgccccccagcctgcagcagaagcctccacagtgagaactggacccaaaggtagtgggggccggtgtggggcagagtcctgaagagccacctctaggaggcagcccctaggagcacgcacgttctgtcagtattaccccacctgtcctatcaggtgggccacaccctgcttgcccacaccagggtctgtcctggtcctcaagccacgcacccgctatgcctgcactgcagcccagccccggacagctccaggatccgtgcagtggctgcgccgccaggccccaacaatggggaccctggggtggctcctggccaagtgttctctgttttcctcgcacctccttacactgtgtgacctgcagggcatgaggtattgatgtgttcgggtttcctttcccaagccagcagatgcaggtgttccaaggtgtgttgctctgtgggatttgtggacacttaagaaacggactgagtgggaaccctgcagccaggggatggggagcctctgctccccccatgctcccaccctggctgagggccagcctcatctgcagagccctggaggaggcccacctatggacacagcccgagagatgggcgcaaggggtgctgggggaggcctgctatcctgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaa

SEQ ID NO: 201326 - DNA, 4895 bp, Homo sapiens
  Payload ID: 19734
  Gene Name: zinc finger CCCH-type containing 4
  ENST ID: ENST00000601973
  CDS Start-End: 1-2731
gaaccagtaccgccgctccaaggacagccgaggccgagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgacggtggtggtggaagctaccggagtcgtgaccatgacaagccccaccagcagtcggacaagaaaggcaaagtcatttgcaagtacttcgtggaagggcgctgcacctggggagaccactgtaattttagccatgacatcgaactcccaaagaagcgagaactgtgcaagttttacatcactggattttgcgccagagctgagaactgcccttatatgcacggtgatttcccgtgtaagctgtaccacaccactgggaactgcatcaatggtgacgactgcatgttttcccacgaccctctgaccgaagagacgagggagctcttggataagatgttggccgatgatgcagaagcaggtgccgaggatgagaaggaggtggaggaactgaagaagcagggcatcaaccccctgcccaaaccgccccctggtgtgggcctcctgcccacccctcctcggccccctggcccgcaggctccaacctctcccaacggcaggcccatgcagggtggccccccgcccccgccccctccccctcccccaccgcccgggccccctcagatgcccatgccggtgcatgagccactgtccccgcagcagctgcagcagcaggacatgtacaacaagaagatcccctccttgtttgagatcgtggtgcggcccacgggacagctggctgagaagctgggtgtgaggttccctggacccggtggacccccagggccaatgggccctgggcccaacatgggacccccagggccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcaggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccagagctgcggctccagccacccttcctagggtggcattcagggcagcacccagggtagggaacttgggggcaaggggaggcaggctgggtgttccttttttcttttctttttcttttgctttccgtctcttttatttttttttaaagtagtactttctttgagatttgtaaattgtatataaccatcttaagttctggtcagtgtggcgggctcaggggctcctgctgagcaaaccgactcatgcccgcaaacctgtgaactttcgccagtgcctggcctcagactctgtgggctctgcgtggccgggccttgctggaggcccagtgggttttctgggcaaagcatggccccttttccccaggacaaagggaacagttggtgtctgggaaggtattgaacgctcctcaccctgtgcccgaagagacccggaaccaagaccatggcagggcctgcgtggaagcaggtccaggcgtttctagaaccctagggtgcaccatcactgtcttttcagtgcaggctgtaacaacccactcaggagacagtgagagtgaaaaggtattaaggaaaaagcccccagcggcactatgggggctccctggcgcatgcctgctcctgtccctggattaccacacgtgccctccctgccaccctccgtctagagcaagcggatgccccccagcctgcagcagaagcctccacagtgagaactggacccaaaggtagtgggggccggtgtggggcagagtcctgaagagccacctctaggaggcagcccctaggagcacgcacgttctgtcagtattaccccacctgtcctatcaggtgggccacaccctgcttgcccacaccagggtctgtcctggtcctcaagccacgcacccgctatgcctgcactgcagcccagccccggacagctccaggatccgtgcagtggctgcgccgccaggccccaacaatggggaccctggggtggctcctggccaagtgttctctgttttcctcgcacctccttacactgtgtgacctgcagggcatgaggtattgatgtgttcgggtttcctttcccaagccagcagatgcaggtgttccaaggtgtgttgctctgtgggatttgtggacacttaagaaacggactgagtgggaaccctgcagccaggggatggggagcctctgctccccccatgctcccaccctggctgagggccagcctcatctgcagagccctggaggaggcccacctatggacacagcccgagagatgggcgcaaggggtgctgggggaggcctgctatcctgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttatttt

SEQ ID NO: 201327 - DNA, 11539 bp, Homo sapiens
  Payload ID: 19735
  Gene Name: zinc finger CCCH-type containing 6
  Uniprot ID: P61129
  ENST ID: ENST00000343936
  CDS Start-End: 395-3964
ttttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataagcataattccccatctagtgatgatagttcggactacagccttgattcagatgttgaacatacagaaagttcccataaaaaaagaactggtttctacagggattatgacattccatttactcagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagagtataataaaccagggaaaaaatggaaggttatgactcaggaatttattaatcagcacacagtggaacacaaaggaaaacaaatctgtaaatacttcctggaagggaggtgtattaagggagatcagtgtaaatttgatcatgatgcagagttggagaaaagaaaagagatctgcaaattttatttacaaggatattgtaccaaaggagagaactgcatttatatgcataatgaatttccatgcaagttctatcatagtggagcaaaatgttaccagggagacaactgtaaattttcccatgatgatctaactaaagaaacaaagaaacttttggacaaagtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtgatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataatatc

SEQ ID NO: 201328 - DNA, 11542 bp, Homo sapiens
  Payload ID: 19735
  Gene Name: zinc finger CCCH-type containing 6
  Uniprot ID: P61129
  ENST ID: ENST00000409871
  CDS Start-End: 402-3971
ggcgccattttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataagcataattccccatctagtgatgatagttcggactacagccttgattcagatgttgaacatacagaaagttcccataaaaaaagaactggtttctacagggattatgacattccatttactcagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagagtataataaaccagggaaaaaatggaaggttatgactcaggaatttattaatcagcacacagtggaacacaaaggaaaacaaatctgtaaatacttcctggaagggaggtgtattaagggagatcagtgtaaatttgatcatgatgcagagttggagaaaagaaaagagatctgcaaattttatttacaaggatattgtaccaaaggagagaactgcatttatatgcataatgaatttccatgcaagttctatcatagtggagcaaaatgttaccagggagacaactgtaaattttcccatgatgatctaactaaagaaacaaagaaacttttggacaaagtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtgatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataa

SEQ ID NO: 201329 - DNA, 3825 bp, Homo sapiens
  Payload ID: 19736
  Gene Name: zinc finger CCCH-type containing 7A
  Uniprot ID: Q8IWR0
  ENST ID: ENST00000355758
  CDS Start-End: 179-3094
aaccgagccgctgccgccgccgctaaccgagggagagctgcgagcgagcacccaggccccgccgccgccgccgccaccgctgcccgcctgccgccgcccgcctccgcctgccttctgccgccggccggcgcgtcgtccccacagattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 201330 - DNA, 3845 bp, Homo sapiens
  Payload ID: 19736
  Gene Name: zinc finger CCCH-type containing 7A
  Uniprot ID: Q8IWR0
  ENST ID: ENST00000396516
  CDS Start-End: 199-3114
aaagatgactcctgtacggtccctgccgtccaggaccctggagtcaagtcagaaatggatgtgtccacagctgattgtgtgacaaggtctggatttgtgggtgttttcattggagtccagggaccctggtaccttatgtgcttttttgccttgtttctttccagattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 201331 - DNA, 575 bp, Homo sapiens
  Payload ID: 19736
  Gene Name: zinc finger CCCH-type containing 7A
  ENST ID: ENST00000576018
  CDS Start-End: 344-575
agcaaaggggtggggccgcctgaggcccggccggggcctccgaggtcgagcctgagtcgggactgggtggatttgccaggagttgggtattttcctgtccccacctgtctagggatgaaaaggagttgcccgtgttcggtattgaaccacgaaggaccttgccatgcccagtacggtggccactgaccccccgccgtttgggacgatggagcccacgaaatggggccagtttcagttgcggtcccagctgtgaaacgtacatctgattttaaaaacttcggatgagaaagaaagtaaaagatgtcattgattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaat

SEQ ID NO: 201332 - DNA, 780 bp, Homo sapiens
  Payload ID: 19736
  Gene Name: zinc finger CCCH-type containing 7A
  ENST ID: ENST00000575041
  CDS Start-End: 1-279
ggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagca

SEQ ID NO: 201333 - DNA, 2632 bp, Homo sapiens
  Payload ID: 19736
  Gene Name: zinc finger CCCH-type containing 7A
  Uniprot ID: Q8IWR0
  ENST ID: ENST00000575984
  CDS Start-End: 1405-1908
gtgagccaccgtgcccggcccgggaccttttttcttaaagaagaaattatactgtatgtgtgtatgtgtgtagagagtgtggtgaggcttaaagacaatgggcttcaaagtctgccagaagggccccagtcaagttattcagcctcagtttgctcacctgtaattgggaataattatgtgtgatggtgttatgtaaacacctggcacagtgcctggccttctcctttacctgcttttcttcctgctccttatcattgagctttgaaagactatggtaaatgtttccctagtaatatgactaagtacttactggggtttgacgggggaaagaatatgactattttatccagtactgactttatgcagaagattttaagggtggggtcactgacattggtccaagggaggaaatgtacagtgttaagggggctgagcgagttttagccaaaactctgaaaaacgtgacagatgctaagcatttaatgccacgtaagctaaataatgtagggccagctgccgttgaagcacaaactaagataagctaataattagttgtactaggatttatacctcatacagacaagtaggttgatggtattcaagaatgcattctccgtgatggaggttttcttggttcctggctcataattcttagggaagtctgcgttctgctgatcacgatcactttattttcctaccagtatcactgtatttactttgttaaataaaaatacaaataacctgaagaggtattatttgaaagctgtgtaactccatggtatggctagtgtgataattgtcttctgataatgcatatgtagtgaattatggccgaggttagtttccagtactggttataagtaagttaaatttctgaaatgttttgggcactgttcagtaccctttggagtagcctgcagtttctttactgctttcaagtgctgatgtggaggaatcattagtgttgggcagggaaacaggagctgtcagactgagagggccagggatgttcattgtggagattaaatgttctgagtaagtgagtttgtagacattttcttgtaagaaaatgttccatgctttactctgttttggacattttcttttgaaaaattttgagatagaaaccttaatatcatttcatatatttagagcatatagttaatttgagtagagtcaaattaatcttactttagaatttgattactaagtattagcatggataataatgcttcttttgcttaaatgtaaaaattaggccgttttactaggtgtactttgtcttaatcatattcctatttttttatacagctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatg

SEQ ID NO: 201334 - DNA, 2343 bp, Homo sapiens
  Payload ID: 19736
  Gene Name: zinc finger CCCH-type containing 7A
  ENST ID: ENST00000571198
  CDS Start-End: 144-2343
agctgcgagcgagcacccaggccccgccgccgccgccgccaccgctgcccgcctgccgccgcccgcctccgcctgccttctgccgccggccggcgcgtcgtccccacagattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtc

SEQ ID NO: 201335 - DNA, 1930 bp, Homo sapiens
  Payload ID: 19736
  Gene Name: zinc finger CCCH-type containing 7A
  ENST ID: ENST00000571405
  CDS Start-End: 1-676
caatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatataga

SEQ ID NO: 201336 - DNA, 986 bp, Homo sapiens
  Payload ID: 19736
  Gene Name: zinc finger CCCH-type containing 7A
  ENST ID: ENST00000576009
  CDS Start-End: 1-986
ataaaactaactcaagaactagctcagaaattgggatttaaaataagaaaagcgtatgtcagagctgaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaagg

SEQ ID NO: 201337 - DNA, 663 bp, Homo sapiens
  Payload ID: 19736
  Gene Name: zinc finger CCCH-type containing 7A
  ENST ID: ENST00000572870
  CDS Start-End: 206-663
aaaacctgaagccaaaggagggaagaggaaaggaaggggagacatgactttttcctggagactgctcaggaggggtatacaaagtctgcatagccattcagccttaaagaatgtgaaaactggccaggcgctgtggctcacacctataatcccacactttgggaggccgagattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagt

SEQ ID NO: 201338 - DNA, 564 bp, Homo sapiens
  Payload ID: 19736
  Gene Name: zinc finger CCCH-type containing 7A
  ENST ID: ENST00000572781
  CDS Start-End: 355-564
gctaaccgagggagagctgcgagcgagcacccaggccccgccgccgccgccgccaccgctgcccgcctgccgccgcccgcctccgcctgccttctgccgccggccggcgcgtcgtccccacagggatgaaaaggagttgcccgtgttcggtattgaaccacgaaggaccttgccatgcccagtacggtggccactgaccccccgccgtttgggacgatggagcccacgaaatggggccagtttcagttgcggtcccagctgtgaaacgtacatctgattttaaaaacttcggatgagaaagaaagtaaaagatgtcattgattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttg

SEQ ID NO: 201339 - DNA, 532 bp, Homo sapiens
  Payload ID: 19736
  Gene Name: zinc finger CCCH-type containing 7A
  ENST ID: ENST00000574995
  CDS Start-End: 351-532
gagccgggccggggcctgtgcgcgcggagggacgggtgggcgcgccgtccccttcccccaccgagaataacgtgacccacttctgcctgccattccctcggcaaaatgtctcctttttgggatgaaaaggagttgcccgtgttcggtattgaaccacgaaggaccttgccatgcccagtacggtggccactgaccccccgccgtttgggacgatggagcccacgaaatggggccagtttcagttgcggtcccagctgtgaaacgtacatctgattttaaaaacttcggatgagaaagaaagtaaaagatgtcattgattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaa

SEQ ID NO: 201340 - DNA, 5909 bp, Homo sapiens
  Payload ID: 19737
  Gene Name: zinc finger CCCH-type containing 7B
  Uniprot ID: Q9UGR2
  ENST ID: ENST00000352645
  CDS Start-End: 258-3191
agggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggccctgtccatcttctccccaccaccgccccggtgtgcgtacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttga

SEQ ID NO: 201341 - DNA, 1601 bp, Homo sapiens
  Payload ID: 19738
  Gene Name: zinc finger CCCH-type containing 8
  Uniprot ID: Q8N5P1
  ENST ID: ENST00000272570
  CDS Start-End: 107-982
ggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttct

SEQ ID NO: 201342 - DNA, 5965 bp, Homo sapiens
  Payload ID: 19738
  Gene Name: zinc finger CCCH-type containing 8
  Uniprot ID: Q8N5P1
  ENST ID: ENST00000409573
  CDS Start-End: 131-1006
gaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttctaaatttagagttcgtaacttttctgttgttaaaatataagaatatttatctttctcattggtttataaactgtagtcagattatacacttgtgtgagttacaaactttaggagtgtgatggtatcattaacacaagattcaaatactaatgttccaagtacaaataataatgagattctaaatatgcagttttatatagtaatattgattattggttattattagacaaataccatgaaatggaaactcgtcattatattgttttattgttgggaaaagtaatagtattaccaacttgctggacatacagagtacaccaaagctagtgatacttcttagcaaagtcctatttgaaaataggaatcaaagttattttcattgttatctaatcctgctaaagcaagaaagggaattgcatatactccaagcaaaggtttatcagacaagacgaaagaaagcaggaaacaagggtaaatcctaggcccttagaagcaggaaactgaggaatggagagcaagtcatctctcagtgcccttttgctgtctgcccaggttgattggttcgcttctcagctgtggctcgggaggtgggcaaggcacttcttatttaagtctcataacaaccttatacagtggataatgcaattcattgcatagaaagggaataaataggaatgcttaattttttaattttcatgagccttgtcaatacttgtagttaatcttatactacagtctagcagtttacttcctaatattacctcatgtataatagtttgatacttataaagtatagattttatatataaagtttatatataaggaaaaaaataattgttatatttctgaggcagtacccatctcacttgtaaacttaaaagacaccgcagagatttgagggactcagaagtcaaatagagtaggttaaaaacctcttatttttcaaattaattgttttaagaaacaagcatacctgtgtaagtgaaatatcttaatttgtgttgaatcaagttaggagacagagattctcatgaatgtgtcctgtgttctcaaagcagctgctagcctgtgggtctctcctacctgggttatggcagcacctcacagccaatcactggcctccattctcccctttcctctgtacagtttgctctggttcctcagagcagatttccgagtatactgcttcagccacgcccccactgtgccgttccctgaaccaagagccattcgtctcaagagccattcgtccaaagtactctatcacctagccattgtagccataccaagccgggcttcctacttccctctgctccccttggtttcctcctgtgaagtaaatctcactgacccttgatgcagctccaagcatatataatatatatataataaaaccatagtctaaaaaattcaaaccaggagaaataaagccagaaagttgtatgggaaaaatctgcacagatttatttggccagcatggttatcatggctctattgaatttatccttgaccgtctttaaagccaaagcaaacgggataaagtgatcaactacttacctctcaataccagaaaggaagcaggaggcaaaatctctcaataatttcataaaaacaattcttagctgggcgcggtggctcacacctgtaatcccagcactttgggaggccgaggtgggcggatcatgaggtcaggagatcgagaccatcctggctaacatggtgaaaccccatctctactaaaattacaaaaaattagctgggcgaggtggcgggcacctgtagtcccagctactcgggaggctgaggcaagagaatggtgtgaaccccagggggcggagcctgcagtgagctgagatcgcaccactgcactccagcctgggcgacagtgagactccgtctcaaaaaaaaaaaaaaaaaaattcttaagtgggtcttcattatggaaatcacagaatagaatggacagaattctcatttctaaaattctgtgtgacaggtttcatatgggtctttttatggtcagttactaaaagccacataatagtagaactaaattttttttttttttttttttttttttttttttttttgagacggagtctcgctctgtcgcccaggctggagtgcagtggtgcgatcttggctcactgcaagctctgcctcccgggttcaagtgattctcctgcctcagcctcccaagtagctgggactacaggtgcatgccaccacaccctgctaattttttgtatttttagtagagactgggtttcactgtattagccaagatggtctcgatctcctgacctcgtgatccacccacctcggcctcccaaagtgctgggattacaggtgtgggccaccgcacccggccagaactcaatttttatctgttggtgagataatataggtcaagtatatagccttttggtgttttaacttgatccaattgtagaactttaggaattcagaccccgagatgttaaatgactgtcccctgttttaataggtttcctgagtttcagcataattgtcttagttcactgactagtttcttataagcataaccactggggggttacgtgcaaggatttcttcaggccgggtgcagtggctcacaccttgaatctcggcactttgggaggccaaggcaggaggatcacttgagttcaggagtttgagaccagccttggcaacatagcaagatctcatctttacaaaaaatttttaaattagccaggcatggaggtgcatacctggagtcccagctacttgagagtctgaggcaagaggatcactggagcccatgaattcgaggttgcagtgagtcctgattgtgccactgcactccagcctgggcaacagagccttgtctcttataaaaaaaaaaaaaaaaaaaaaaagcatttcttctgagttgtgcttgctgaactcaaaatactaggtgatttggtaatgcgcctaaagagcatggggctcctcctgccaattataagcaaagacatcacatttggagtttggcaagatcagaatatctcaggttgagcacctgctgaatgctaggattgtgtctatgcattttaaatctatttttaatctttattacagtcttataatagggattatgacaccagaacagagacagctgtcttaagatttcaaggggtgctagctgaagaaaacagagaggaaagttgggaagaagctggatccttgataacagctgagccatggacttaaccagtcttagatgagcgatacctcaccttcagatttcatgtcataccacctgaaataatatattttcattattgttgaagccattttgatttgggttgtctactatgctacctgcagccaaagggaaactaataaatgtgaactaagaagcaaacctacattcttcttcccaaagtccatgtttctccccctcgccatcctcttcaccaaaaactacattcattgtattcagctcctgcaaagagcacacattaagaaacaggtttaaggaagtgttagacactgaatgtattcgacccccaaaattcatgtgttgaaatcctgactcctaggactaactgttaggaggtagggcctttgggagatgattgggttttgagggtggagcccctcatgaatgggattagtgcccttataaaagaggccctggggagctgtctcccttttccaccatgtgaggacacggcaagaaaatggctgtctacaaagcaggaagcaggccctcaccacacactaatataccagcaccttgaccttgacctccccccatctccagaactgtgaggagtaagtgttgtttaagccacctagtctgtggtatttttgttataatagcccaaatggactaagaaatgaagagaaattaagatggggagggctattttcataataaggagcagaaaactaggaagagtagatatatttagaagggttaagaggagaggggagaatgtatatgtttggatagggagggacaagatgcccaactcatcttaaaagtgctgttgattcctgtgaaatttgtaacactcatttacattatttaaaaataaactaaattcgaacttgtcttggaggcatgaaagaaaaaaaaagacatgtttttagttattgtatgttactctgagctacacattatttaacatctctgaaactggaatatattttacaattgatagactcattttaattagcaggttattgttttcttagcagtacataagaaatggtgaatcttattgattcagtggcatttagattctattaaatataatttttaactgaagttgtacatagttaaataaaagtttactatgaaataaa

SEQ ID NO: 201343 - DNA, 1527 bp, Homo sapiens
  Payload ID: 19738
  Gene Name: zinc finger CCCH-type containing 8
  ENST ID: ENST00000615791
  CDS Start-End: 45-938
ctctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttact

SEQ ID NO: 201344 - DNA, 7100 bp, Homo sapiens
  Payload ID: 19739
  Gene Name: zinc finger CCCH-type, antiviral 1
  Uniprot ID: Q7Z2W4
  ENST ID: ENST00000242351
  CDS Start-End: 318-3026
gaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatcagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtatttttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcatcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 201345 - DNA, 4776 bp, Homo sapiens
  Payload ID: 19739
  Gene Name: zinc finger CCCH-type, antiviral 1
  ENST ID: ENST00000464606
  CDS Start-End: 24-3098
agagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacggtaaatacaaagggaagacactttgggctagtacatttgttcatgatataccaaatggctctagtcaagtagtggataaaactactgatgtagaaaaaactggtgccactggttttggcttaacaatggcagtcaaggcagaaaaagatatgttacgtactggaagtcagagtctgaggaacctggtccccaccacacctggggaatccactgcccctgcacaagtcagcactctgcctcagtcacctgctgccctttcctcaagcaacagagctgcagtctggggggcccaagggcagaactgcacccaggttcctgtttcctctgccagcgagctcacaaggaagacaacaggctctgctcagtattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatcagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtatttttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaa

SEQ ID NO: 201346 - DNA, 3182 bp, Homo sapiens
  Payload ID: 19739
  Gene Name: zinc finger CCCH-type, antiviral 1
  Uniprot ID: Q7Z2W4
  ENST ID: ENST00000471652
  CDS Start-End: 389-2488
cttttagtttctcttctttctaaagaaggctcgcggagcccggctggagaacctcaccctcgccgagcctagaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattcttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaaca

SEQ ID NO: 201347 - DNA, 1487 bp, Homo sapiens
  Payload ID: 19739
  Gene Name: zinc finger CCCH-type, antiviral 1
  ENST ID: ENST00000460845
  CDS Start-End: 1-793
ggaatccactgcccctgcacaagtcagcactctgcctcagtcacctgctgccctttcctcaagcaacagagctgcagtctggggggcccaagggcagaactgcacccaggttcctgtttcctctgccagcgagctcacaaggaagacaacaggctctgctcagtattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattcttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaaca

SEQ ID NO: 201348 - DNA, 1753 bp, Homo sapiens
  Payload ID: 19740
  Gene Name: zinc finger CCCH-type, antiviral 1-like
  Uniprot ID: Q96H79
  ENST ID: ENST00000275766
  CDS Start-End: 13-915
gcgccagcgaccatggcggagcccacagtgtgctccttcctcaccaaggtgctgtgcgcccacggcggccgcatgttcctgaaggacctgcgcggccacgtggagctgtcggaggccaggctccgggacgtgctgcagcgcgccgggcccgagcgtttcctgctgcaggaggtggagacgcaggagggcctcggggacgcggaggccgaggcggcggccggcgcggtgggcggtggcggcacctccgcctggagggtggtggccgtgtcctctgtgcgcctctgcgcccgctaccagcgcggcgagtgccaggcctgcgaccagctgcacttctgccgccggcacatgctgggcaagtgccccaaccgggactgctggtctacctgtaccctttcccatgatatccacacacctgtcaacatgcaggtcctgaaaagccatggactttttggtctcaatgaaaaccagcttcggatcctgcttttgcagaatgacccctgtcttttaccagaggtctgtttgctctacaacaaaggggaagccctgtatggctactgcaacctcaaggataaatgcaacaagtttcatgtgtgcaaatcctttgtgaaaggagaatgcaaacttcagacctgcaaacggtcccatcagcttatccatgctgcatctttgaagctgctacaggaccaaggactgaatattccaagtgttgttaattttcagataatctccacctacaagcatatgaagctgcacaagatgcttgaaaatacagataattcatcaccttcgactgagcattcacaaggccttgagaagcaaggagtgcacgcagctggagctgcagaagctggtcctctggcttctgtccctgctcagtcggccaagaagccctgcccagtgtcttgcgagaagtaaagaagatggaaaaggagaaaatgtccttttggaagaatacatttgggcatgggtggttggggatggggtgggacattgaacaggcaaagagaggctaaaattgagtgcagatggggctagtccagggcaagtgctgaagatggcagctgctatctgcagctcctaggtgctttcctcaggctgggtagatggagctctgctgacttctgtggtccaccattgtttttctatcaatttatattgtggcaatcctagagtactttgcactcatttttttttttcacttaatattgtctcataagcatctttctatatttgttcacatcgtacataatcatgtttttgcacagatacattaatattatcatagtttgtttaactacttggctttttctaacagtttttttttttgagatggtcttgctctgttgcccaggctggagtgcagtgacgtgatctcggctcactgcagccttgacttcctgggctcaagtgatcatcccacctcagcctcctgagtagctgggactacaggtatgcaccacgaccagctaattttttgtattttttttttgtagagagggtattttgccatgttgcccaggctagtcttgaactcctgggctcaagcgatctgcctgcttcagcctcccagagtgctaggattacaggcatgagccactgcacccagcctcttaacaaattttgaatataactcctgtcttaaaatctgcagaatattgaatttttccagctattttttacttttgcttagcttatagatgctaaaggatactgtcatttgcatttttaaaaatatatgtatgagtgaatagtt

SEQ ID NO: 201349 - DNA, 1827 bp, Homo sapiens
  Payload ID: 19741
  Gene Name: zinc finger CCHC-type and RNA binding motif 1
  Uniprot ID: Q8TBF4
  ENST ID: ENST00000266529
  CDS Start-End: 185-838
gcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtctttaaatatgggtgttttgtcatcatatttcttgtagctttatcccaatctggataaattgtaaatacctataaaataaattataaatacctataaaatataaagtaacatagctctaaaaggcttaaaatcaaacacaggtgttatttgtctgccctacccatagcaccaaattccattccctagaagaaactacttacatgtgcacacatgtagctaaataaagtacatatatttcagtcacttaataaaagaataaaggagaattattcaatctcttatacttctcctaccttcctcaatattcccaatgtggctgtattaaaaatttgggggaatccatatatatcttttttaataaccaagtaaatacttttcatttctgagccaaggaatatgctatgattacgttttttcctagagttaataattgtctattttttttccatgtattgtctttgtatttatgactaaatcttcccattctgtctgcaggtgggtatatggtaatgggattagagagcctttaattttctgctttgtatatttctatattgtttaactttgtaagaatgcccattacttttttaactagtaaaagcaatagaaataagttaatactatcatagtaatattattattgtcatcccaagaaaaaatatattaaaaagatatttgaaatttcattataaaa

SEQ ID NO: 201350 - DNA, 907 bp, Homo sapiens
  Payload ID: 19741
  Gene Name: zinc finger CCHC-type and RNA binding motif 1
  ENST ID: ENST00000552673
  CDS Start-End: 241-771
cgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatatttta

SEQ ID NO: 201351 - DNA, 633 bp, Homo sapiens
  Payload ID: 19741
  Gene Name: zinc finger CCHC-type and RNA binding motif 1
  ENST ID: ENST00000552235
  CDS Start-End: 235-633
gcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccag

SEQ ID NO: 201352 - DNA, 5423 bp, Homo sapiens
  Payload ID: 19742
  Gene Name: zinc finger E-box binding homeobox 1
  Uniprot ID: P37275
  ENST ID: ENST00000320985
  CDS Start-End: 111-3485
gtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaa

SEQ ID NO: 201353 - DNA, 5990 bp, Homo sapiens
  Payload ID: 19742
  Gene Name: zinc finger E-box binding homeobox 1
  Uniprot ID: P37275
  ENST ID: ENST00000361642
  CDS Start-End: 64-3441
gggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctt

SEQ ID NO: 201354 - DNA, 6267 bp, Homo sapiens
  Payload ID: 19742
  Gene Name: zinc finger E-box binding homeobox 1
  Uniprot ID: P37275
  ENST ID: ENST00000446923
  CDS Start-End: 392-3718
tttctccctcccctctgggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctt

SEQ ID NO: 201355 - DNA, 6246 bp, Homo sapiens
  Payload ID: 19742
  Gene Name: zinc finger E-box binding homeobox 1
  ENST ID: ENST00000437844
  CDS Start-End: 20-181
agacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctta

SEQ ID NO: 201356 - DNA, 887 bp, Homo sapiens
  Payload ID: 19742
  Gene Name: zinc finger E-box binding homeobox 1
  ENST ID: ENST00000424869
  CDS Start-End: 20-887
agacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagca

SEQ ID NO: 201357 - DNA, 3217 bp, Homo sapiens
  Payload ID: 19742
  Gene Name: zinc finger E-box binding homeobox 1
  Uniprot ID: P37275
  ENST ID: ENST00000542815
  CDS Start-End: 14-3187
aagcgagaggatcatggcggatggccccaggtgtaagcgcagaaagcaggcgaacccgcggcgcaataacggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaa

SEQ ID NO: 201358 - DNA, 3368 bp, Homo sapiens
  Payload ID: 19742
  Gene Name: zinc finger E-box binding homeobox 1
  Uniprot ID: P37275
  ENST ID: ENST00000560721
  CDS Start-End: 24-3338
atttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacataaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaa

SEQ ID NO: 201359 - DNA, 1500 bp, Homo sapiens
  Payload ID: 19742
  Gene Name: zinc finger E-box binding homeobox 1
  ENST ID: ENST00000561212
  CDS Start-End: 679-1500
ggggactccgcggcgagccccgcgagtggggtccacgtttggcggggcgcggcggggcggcgcggggaacaaggcaggaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaattta

SEQ ID NO: 201360 - DNA, 1205 bp, Homo sapiens
  Payload ID: 19742
  Gene Name: zinc finger E-box binding homeobox 1
  ENST ID: ENST00000559476
  CDS Start-End: 375-1205
ggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatc

SEQ ID NO: 201361 - DNA, 886 bp, Homo sapiens
  Payload ID: 19742
  Gene Name: zinc finger E-box binding homeobox 1
  ENST ID: ENST00000558440
  CDS Start-End: 23-886
tttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttca

SEQ ID NO: 201362 - DNA, 3913 bp, Homo sapiens
  Payload ID: 19743
  Gene Name: zinc finger E-box binding homeobox 2
  ENST ID: ENST00000303660
  CDS Start-End: 138-3779
acttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcg

SEQ ID NO: 201363 - DNA, 1514 bp, Homo sapiens
  Payload ID: 19743
  Gene Name: zinc finger E-box binding homeobox 2
  ENST ID: ENST00000392861
  CDS Start-End: 114-1514
atcatttagtagagcttaaaagtattgccgtagtggttggactttctctttcctttcttaagggaaaaaaaaaattctactggaactatttaagggaaccagtgtgggggagcatgtgtgtgagtgagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcactta

SEQ ID NO: 201364 - DNA, 5361 bp, Homo sapiens
  Payload ID: 19743
  Gene Name: zinc finger E-box binding homeobox 2
  Uniprot ID: O60315
  ENST ID: ENST00000409487
  CDS Start-End: 284-3928
agaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaact

SEQ ID NO: 201365 - DNA, 587 bp, Homo sapiens
  Payload ID: 19743
  Gene Name: zinc finger E-box binding homeobox 2
  ENST ID: ENST00000409211
  CDS Start-End: 228-587
atagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagatttt

SEQ ID NO: 201366 - DNA, 1755 bp, Homo sapiens
  Payload ID: 19743
  Gene Name: zinc finger E-box binding homeobox 2
  ENST ID: ENST00000419938
  CDS Start-End: 234-896
caggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaa

SEQ ID NO: 201367 - DNA, 2236 bp, Homo sapiens
  Payload ID: 19743
  Gene Name: zinc finger E-box binding homeobox 2
  ENST ID: ENST00000427902
  CDS Start-End: 43-2236
ttactgtaccgccgtgtgcattccctcatacggtcaggagttatgactcattttgaagatatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaatt

SEQ ID NO: 201368 - DNA, 577 bp, Homo sapiens
  Payload ID: 19743
  Gene Name: zinc finger E-box binding homeobox 2
  ENST ID: ENST00000444559
  CDS Start-End: 389-577
ggaggtggaatttcatttcttccactaaagcgtttgcggagacttcaagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagct

SEQ ID NO: 201369 - DNA, 554 bp, Homo sapiens
  Payload ID: 19743
  Gene Name: zinc finger E-box binding homeobox 2
  ENST ID: ENST00000435831
  CDS Start-End: 281-554
gtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacgatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtg

SEQ ID NO: 201370 - DNA, 4061 bp, Homo sapiens
  Payload ID: 19743
  Gene Name: zinc finger E-box binding homeobox 2
  Uniprot ID: O60315
  ENST ID: ENST00000539609
  CDS Start-End: 251-3823
agttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttca

SEQ ID NO: 201371 - DNA, 4012 bp, Homo sapiens
  Payload ID: 19743
  Gene Name: zinc finger E-box binding homeobox 2
  Uniprot ID: O60315
  ENST ID: ENST00000558170
  CDS Start-End: 202-3846
cgaagtttcgctttggcgttggggggcgcggatgggtgctcgccggggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttgga

SEQ ID NO: 201372 - DNA, 709 bp, Homo sapiens
  Payload ID: 19743
  Gene Name: zinc finger E-box binding homeobox 2
  ENST ID: ENST00000431672
  CDS Start-End: 157-709
gggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgccc

SEQ ID NO: 201373 - DNA, 2648 bp, Homo sapiens
  Payload ID: 19743
  Gene Name: zinc finger E-box binding homeobox 2
  ENST ID: ENST00000470879
  CDS Start-End: 80-343
gaaggaaagggtccgcctagccctgagtcaagcggtcttactgtaccgccgtgtgcattccctcatacggtcaggagttatgactcattttgaagatatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaa

SEQ ID NO: 201374 - DNA, 656 bp, Homo sapiens
  Payload ID: 19743
  Gene Name: zinc finger E-box binding homeobox 2
  ENST ID: ENST00000462355
  CDS Start-End: 209-385
aaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagttt

SEQ ID NO: 201375 - DNA, 2949 bp, Homo sapiens
  Payload ID: 19743
  Gene Name: zinc finger E-box binding homeobox 2
  ENST ID: ENST00000465070
  CDS Start-End: 464-640
ctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtg

SEQ ID NO: 201376 - DNA, 1809 bp, Homo sapiens
  Payload ID: 19743
  Gene Name: zinc finger E-box binding homeobox 2
  ENST ID: ENST00000440875
  CDS Start-End: 538-1809
atttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaaactcaaggagacagtggctcatgcctgtaatcccagcactttgggaggccaacgagggtggatcaggtcaggagtttgagaccagcctggccaacatggtaaaacaccatctgtcctaa

SEQ ID NO: 201377 - DNA, 2564 bp, Homo sapiens
  Payload ID: 19743
  Gene Name: zinc finger E-box binding homeobox 2
  ENST ID: ENST00000629520
  CDS Start-End: 83-259
cggagacttcaagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaa

SEQ ID NO: 201378 - DNA, 845 bp, Homo sapiens
  Payload ID: 19743
  Gene Name: zinc finger E-box binding homeobox 2
  ENST ID: ENST00000484313
  CDS Start-End: 91-216
gcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaa

SEQ ID NO: 201379 - DNA, 468 bp, Homo sapiens
  Payload ID: 19743
  Gene Name: zinc finger E-box binding homeobox 2
  ENST ID: ENST00000630572
  CDS Start-End: 351-468
gggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaaggatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatg

SEQ ID NO: 201380 - DNA, 9541 bp, Homo sapiens
  Payload ID: 19743
  Gene Name: zinc finger E-box binding homeobox 2
  Uniprot ID: O60315
  ENST ID: ENST00000627532
  CDS Start-End: 527-4171
tggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 201381 - DNA, 583 bp, Homo sapiens
  Payload ID: 19743
  Gene Name: zinc finger E-box binding homeobox 2
  ENST ID: ENST00000434448
  CDS Start-End: 184-309
aacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgggtcatcaagattgtcagaaaaggcctggactacatgcctgtcccagcactagattgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaagg

SEQ ID NO: 201382 - DNA, 1071 bp, Homo sapiens
  Payload ID: 19743
  Gene Name: zinc finger E-box binding homeobox 2
  ENST ID: ENST00000465308
  CDS Start-End: 647-1071
agacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatc

SEQ ID NO: 201383 - DNA, 2876 bp, Homo sapiens
  Payload ID: 19744
  Gene Name: zinc finger family member 783
  Uniprot ID: Q6ZMS7
  ENST ID: ENST00000378052
  CDS Start-End: 164-1009
aaagggccagcggggcacgtggctcgggacgcagttcgctgccgcccggcagtagctctcaggttaggcgggtcccgctccgcttccgccgtcgctgccgcgccgccccgggcccgacaggccgggtccagggactgcaacccagcgagggacgcgggcagccatggccgaagcggcgcctgcccgggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggaggccaggccaccaccaagccagatctggcaccagtggagaaaggagacaggcaggcaactgcagcctgcccagtgcggagaggggccagagcccgggcactgatttctccaggagagagctttgtttacccccaaggactgggcttcactcctaaaagctgcttctaaaccctttgcgtgcaggccccagacagtgtgggtgcatgactgctttatctgttggatgtttccacaggcaggctgttgctgccagaattctagaagcagtgtaaacgggctgctcattcattagggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtg

SEQ ID NO: 201384 - DNA, 4452 bp, Homo sapiens
  Payload ID: 19744
  Gene Name: zinc finger family member 783
  Uniprot ID: Q6ZMS7
  ENST ID: ENST00000434415
  CDS Start-End: 164-1804
aaagggccagcggggcacgtggctcgggacgcagttcgctgccgcccggcagtagctctcaggttaggcgggtcccgctccgcttccgccgtcgctgccgcgccgccccgggcccgacaggccgggtccagggactgcaacccagcgagggacgcgggcagccatggccgaagcggcgcctgcccgggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggtggtggtgtggccatcaagacagaggcacagtctgaagacgagatgacgcctgagcggctctttctgggggtgtcccgaggccagaccgagtgtagaatcccccgagggcccaggaacaggcctgggggccccagccgtcatcaggcccagggcatgcccagggtgcgggcaggggagccacggccaccgggggccagtggggagacgccccgagtcctctcccgcaggcggcagcgggcattcccctgccccgactgcgggcagagcttccgcctgaagatcaatctgacgattcatcagcggacccatgtggaggaggggcggcaggaggcccccggccgctcgcccaccagctgcggggacagccaggccatgctggagccgggggaggtggtggtacccggccctgtcatccgctggctccccgaggagcctgagggtcgccgctccgtggcagggggccgtgccttggtggggcggcggcctgcagccagcaagatgtaccactgcagcgagtgcctgcgcttcttccagcagcgcaagagcctgctgctgcaccagcgcctgcacaccggcaatggccagggctggcccgcctgcccctactgcggcaaggccttccgccggccctcggacctcttccggcaccagcgcatccacaccggtgagcggccctaccagtgcccccagtgtggccggaccttcaaccgcaaccaccacctggccgtgcacatgcagacccacgcccgaggccaggtgggcccacacttccctgccgcccccgcccgccacgggagcctgcccctgccctggcccagccggaaggaggagggctgacctggcaggagcccacagaggacccctggcggggtctctcccctgtgcctgacgcaggttcttccttttcctgggatggagagaggtttgttgtttttacccattcaaatgggaagctagctgcccttctggtgacattgtgtgtgaccgggtgctttctgtttcctgtttgcactcttcgctgccttttctgcattcctgacttctaaaagatgccttaaggcttaagggatgccatatttttgataaggcctctggtaggtaccacagccaagaggaccagagatcatggcccttccagtatgggggcgatagagacatcggggacctgggatttttgttttgtgcagagatctcctgcctgctgtcaccatgagaaacagtggagtggagtggatggatggcctgacttgaagaaagggccctggaaagttttctactttgctattttgaaatttttttcccttcttatagagactttgaaatacttttgtaaatgtgtgtagttgttaatggaactttgccttttgcaaagtcggaaagagtcggcttttccatgtgaggctcgcagagctgaaaggggagctacgtccaccagcctgtgggtcttttggttttttttttgttgttgttgttgtttttttaagatggagtttcactcttgttgcccaggctggagtgcaatggtacaatctccgctcactgcaacctccgcctctcgggttcaggtgattctcctgcctcagcctcctgagtagctgggattacaggcgcccaccaccactcccggctaatttttgtatttttagtagagacagggtttcatcatgttgtccagactggtctcgaactcctgatgttaggtgacccgcacacctcggcctcctgaagtgctgggattacaggcgtgagccaccactcttggcccagcctgtgggttttgatggggatgtcttggctgctgtcttggaggcacagtgtctccccatgtgtgtgtttcttggcccagagtgactcccagtattcctagtccttccccacaggatagtcacatccattatttacttttgttgtcagctgggaggggaaactgaagcctggacacgtctccccaagggctcagtgttcatgggtgtgtaagatccattgactggaccccagaaagcaccctgaggggcagtgcagagagagcccaggaagcccctccactagaggaggcccttggtctggctgaggaccacgtccaccctgggcctccaggcctgcttttcacattaaaggcggggcagtctcctctcaaaggagttctcccttgagcactttgggctctggggcagagttgggctaggagatctgggtgaatcctttagtcacagctagtctcatgttcctcttctgtcaaaggggtcatggccccagtgtgtcctacctcagagttgtcagggtcaaagtaacaggcactgggacaaatatgaagcctagctttgtgcttcctttcaaattcagggcctcctttctactccattccagcctttttttcctgtcagaatccctcaggaaggacctttatcttctggagtgagtggcagttccactgggttcagtgaaagagtcgcccatggggctctgttccccaggagtcctttgtattttggtgaacaaattcttaccaaagcatgagattcggactgtagaagttcagactgcctcagttcagactgcctcatggggcagtctggaggtcagctggcttctggtgtctctcatcacaccactgcggacgctgtctgtagagcagccttggtgtgggtgactctgaagctggagtgatgggaccccagctatccttgttttttaccgccttgtctggcactgtgaccacgcttcagggctgcttctgggggtcttggtccctggatgtgccatttccttgcccttctgaccctcacacttcttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtgcaagtgcaggtgcacgagtttaaccctcagctgcaggagctagtctcaggtgttctggggatgcctcaggctaagaattttgccgactttctgggcttggttggctaatgccaaatgcccctgcttaaatatcacaaggtgctgattctccttttttctttttttcataccaatgtgctcaaactttgagctaggtcttgtgagtttgcctagcactcagacctgtttaagtaacgttctttacattgaaacaagtcaaccgaagctttgtggtgcaggagctgagggtgccccagactcagtgggagccctggttgggccccaaactctcccagcagggtcctcggtttcctcatttgtgaaataaatgagtgggccacgacgttaataagcccaagagaactgtgaaggtggtagtcccttgccctaattggtgctcaataaagttgttggcataaacga

SEQ ID NO: 201385 - DNA, 2346 bp, Homo sapiens
  Payload ID: 19744
  Gene Name: zinc finger family member 783
  Uniprot ID: Q6ZMS7
  ENST ID: ENST00000476295
  CDS Start-End: 120-965
cccggcagtagctctcaggttaggcgggtcccgctccgcttccgccgtcgctgccgcgccgccccgggcccgacaggccgggtccagggactgcaacccagcgagggacgcgggcagccatggccgaagcggcgcctgcccgggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggaggccaggccaccaccaagccagatctggcaccagtggagaaaggagacaggcaggcaactgcagcctgcccagtgcggagaggggccagagcccgggcactgggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggcagcatggtgctgggcgctgcaggggctcattaatgcatgagacacagattccactcaggagagagaagacgaacacagacacagtacacgagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggt

SEQ ID NO: 201386 - DNA, 1929 bp, Homo sapiens
  Payload ID: 19744
  Gene Name: zinc finger family member 783
  ENST ID: ENST00000481519
  CDS Start-End: 348-1094
ccagattctgtcatgacctgcctggcgatcattaccgtgatttcctgtctgctgaattcctgtgctgcagtttccttctgtgggacatgaggctttagactggaatctagctgccaggcctccctccgtatccagagcacctcaccagcccacttagccctgcccaggaggagctgaaagaagggcaggcccccaagcagcagcaggactcagaggcgagagtggccccagccgggccagaagcaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggagactcctgaatctcagagcaggaagcatgtggagatcatttcttcagccctctgtcttcaggcaggtagaaggccaggccaccaccaagccagatctggcaccagtggagaaaggagacaggcaggcaactgcagcctgcccagtgcggagaggggccagagcccgggcactggtgagtccctcagggtgtgggcctgggcctctccacctgcatctgggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtga

SEQ ID NO: 201387 - DNA, 777 bp, Homo sapiens
  Payload ID: 19745
  Gene Name: zinc finger family member 788
  ENST ID: ENST00000397759
  CDS Start-End: 1-777
agatctcacactagagaaaaacgctataaatgcaagcaatgtggaaaacccttcatttatttcaatgcctttcaacgtcatcaaaggagccacactggagagaacccctatgagtgtaagcaatgtgggaaagcctgtatttcttccactgcttttcagtgtcgtgaattgagtcacactggagcaaaacgctataagtgtaagcagtgtggcaaaggcttcaatttgcccagttccattcgatatcatgaaatgactcacactggagagaaaccctatgaatgtaagcaatgtgggagagctttcagatctgcctcacacctacgaacacatgaaaggactcacattggggagaaaccctatgaatgtaaacagtgtggtaaagtctatcgttactggagtggccttcgaatacatggactaactcatattggaaaaaagccttatgaatgcaaggaatgtgggaaagcatttgataatcctacatcctttcaaaaacatgaagggagtcacagaaaagggaagtcttatgaatgtaaggaatgtgggaaggtattcagtttttcccgttcctttcgtagacatggaaggatgcacactggagagaagccatatgaatgtaagaattgtgggaaagccttcacatctgccaagagccttcaaaatcatggaaggacacacaccggagagaaaccatgtgaatgcaagcaatgtggcaaagctttcatttgttccagttcctgtcagagacatgaagagacacattctgttaatatg

SEQ ID NO: 201388 - DNA, 3941 bp, Homo sapiens
  Payload ID: 19745
  Gene Name: zinc finger family member 788
  ENST ID: ENST00000430298
  CDS Start-End: 206-394
aacttttttcggggaaggagacggctgcaagcccgcggtctcttgttgctgtgctaacgaccgttggaaccctctttctggctcttggaacgctcggctctgagaggctccaggtttctccgccagagctcctgtcgctctgtcagttgcgctgtgttcctctctagtcacaagagccttggggaagacagttggaagctcagacatggactcagtggcctttgaggatgtggctgtgaacttcaccccagacgagtgggctttgctggatccttcccaaaagaatctctaccgagaagtgatgcaagaaaccttgaggaacttggcctctatagaggtcttatggaagagagactctttgaaagtgaaggtcatcagcatggagaaattttgacccaggttctggatgacatgctgaagaagaaaactggagtagaatcatgtgaaaggaatgtgtgtgaggtcagcatgggtcatttatcccttaataagcacaccagagctgacactggacacaagccatatgagtatcaggaatatggacagacgccatataaatgtacatactgtaagaaagccttcagctgtctcccctacttttgcagacatgtaattgcacacactggagaaaaaccctatgaatgtaaggattctgcgaagacatttagtttttccatttattttcatagtcataaaagagctcactctggagggaacccctatgaatgtaaacaatctggaaaaccctttggatgcgcctcagaacttcaaatgcatgcaaggactcagtgtggagaaaccttacaaatgtaagaaatgtgaaaaagcatttaataacttatcttcctttcaaatacatgaaagaatgcacagaggagggaagtatcatgcctgtaagggttctgggaatacataccgtttttctggtttctatcatagacataaaatgcctcatgctggcgggaagttttatggatgtaagaaatgtgggaaagcctttattagtttctgtgcctttcgataccatcaaaggactcacactaaagagaaaccctatgcgtgtaaacaatgtgggaaagcctatatttcttacacttcttttcaatatcatcagttgaatcacactggagcgaaatgctatgagtgtaagcagtgtggcaaaggcttcgatttgcccaattccattcgatatcatgaaatgactcacactggggagaaaccccatgaatgtaagcaatgtgggaaaactttcagatgtgcctcaagcctccgaatacatggaaggactcacactggggagaaaccctatgaatgtaaacagtgtggtaaagtctctcgttattggagcggccttcaggtacatgaagtaactcatattggaaaaaagctttatgaatgtaaggaatgtgggaaatcatactatagttctggttcctttctaaatcataaaaggatccacaccagggagaagtcttatgaatgcaaggaatgtgggaaagcatttggtaatcccatatcctttcaaaaacatgaagggagtcacagaaaatggaagccttatgaatgtaaggaatgtgggaaggtattcagtttttccagttcccttcggagacatgaaaggacacacactgaaaaactctgtgaatgtaaacagcatgggaaaggattttttcatagaagctgtcctagacacatgaagatagacactggagagatacttcataaacgtaagatacgtggaaaagtctttcattctcctagttcatttcaaacatgtgaaagatctcacactagagaaaaacgctataaatgcaagcaatgtggaaaacccttcatttatttcaatgcctttcaacgtcatcaaaggagccacactggagagaacccctatgagtgtaagcaatgtgggaaagcctgtatttcttccactgcttttcagtgtcgtgaattgagtcacactggagcaaaacgctataagtgtaagcagtgtggcaaaggcttcaatttgcccagttccattcgatatcatgaaatgactcacactggagagaaaccctatgaatgtaagcaatgtgggagagctttcagatctgcctcacacctacgaacacatgaaaggactcacattggggagaaaccctatgaatgtaaacagtgtggtaaagtctatcgttactggagtggccttcgaatacatggactaactcatattggaaaaaagccttatgaatttaatgaccgtgggaaatcattctatagttccaatttctttctaaatcataaaagggtccacactagagtgaagacatatgaatgcaaggaatgtgggaaagcatttgataatcctacatcctttcaaaaacatgaagggagtcacagaaaagggaagtcttatgaatgtaaggaatgtgggaaggtattcagtttttcccgttcctttcgtagatatgaaagggcacacactggcgaaaagccctgtgaataaacaatgtgggaaaggatttttcatatcttctgtggagctttgaatgcatgaaaagacagactacagagaaatgctaaatgtaaggcgtgtataaaagcatttagtaatttctcttccttgcttatacatggaaggatgcacactggagagaagccatatgaatgtaagaattgtgggaaagccttcacatctgccaagagccttcaaaatcatggaaggacacacaccggagagaaaccatgtgaatgcaagcaatgtggcaaagctttcatttgttccagttcctgtcagagacatgaagagacacattctgttaatatgcattcagttatcctaattcctttgaaacacagaaaaagagtagggaaaggacctctgagataactgttttctgagttgagaagagctacttgtgaatggacaattaaatctagatgtatttagatctgatacaattcatctgtagccaacctttttttaaatttttttattttttagatggagtcttgctctgtcgcccagactggagtgcagtggcacgatcttggctcactgcaacctccgcctcctgggtttaagcaattctcctgcctcagcctcccaagtagctgggattacaggtaaccgccatcacgcctggctaattttagagatggagtttcaccatgttggccaggctggtctcaaactcctgacctcaagtgatccacccacctcggcctcccaaagtgctgggattacaggcgtgagccactgcgccctgccacctatagccaatcttaatgagatttcataggcacagacaaggaaggttatcagtcacatattagaggcaccacacagggagagcagtgtgtggccacatgcttcagcccattttttctgattctcttgcttgcaaattaagagtattctccaaatcacttgactttccttttctcagagttatagttctccagagatgtcaccagatgattcacattaaaggtacatttccagttgacttttttatttcagatattagtaaatgattaccagagaactaattcaaactgtcatggttggaaatactctgatgctcaactccctaatctatagagtgagttaaggtctatactcttttgcaagcattgttctagtggcagtgaccctgttcatgattcagcctgacatttactatgctgccctgaaaaccaactagatgggagcttgtttctctctgcattgtgtagtgagtggtgtcacccaggactttcatgtgagaaaaagcaccttgcttttaatctgggaattttgagtgttttttgtaatgcctcagtttattcttatttatggttgattatatgtgatttagaacacttgctatttatgtctgatcccacaaatcagcactcactttatttgcaaagcaccaaatttcgtgtaagaggtgtagtaattgggaatgtgaagctaa

SEQ ID NO: 201389 - DNA, 692 bp, Homo sapiens
  Payload ID: 19745
  Gene Name: zinc finger family member 788
  ENST ID: ENST00000596883
  CDS Start-End: 88-336
tccgccagagctcctgtcgctctgtcagttgcgctgtgttcctctctagtcacaagagccttggggaagacagttggaagctcagacatgagaaatatgattccacaggacaatgaaaacccaccccaacagggtgaagcaaatcaaaatgactcagtggcctttgaggatgtggctgtgaacttcaccccagacgagtgggctttgctggatccttcccaaaagaatctctaccgagaagtgatgcaagaaaccttgaggaacttggcctctatagaggtcttatggaagagagactctttgaaagtgaaggtcatcagcatggagaaattttgacccaggttctggatgacatgctgaagaagaaaactggagtagaatcatgtgaaaggaatgtgtgtgaggtcagcatgggtcatttatcccttaataagcacaccagagctgacactggacacaagccatatgagtatcaggaatatggacagacgccatataaatgtacatactgtaagaaagccttcagctgtctcccctacttttgcagacatgtaattgcacacactggagaaaaaccctatgaatgtaaggattctgcgaagacatttagtttttccatttattttcatagtcataaaagagctcactctggagggaacccctatgaatgtaaacaatctggaaaacccttt

SEQ ID NO: 201390 - DNA, 1603 bp, Homo sapiens
  Payload ID: 19746
  Gene Name: zinc finger homeobox 2
  ENST ID: ENST00000412565
  CDS Start-End: 520-1603
acgcccgttgtggcggtgccgagagcaggccagggctcgagacacgcgctatgtaatgggaggccgcgacccccgcggtggccaggggagcgaggccgccccttgcattctgctcctcattgttggccccgcacggctcccgggggctggtacaggtctcatgcctgaggctgagccaggcaccccgaggcgcggatgcatgatgggagatgtagttccaaagggagactttgccatctcgccccgcccgtcgctatggcgacaggaaagctgcacttggtgcctgcggtactctacctaaagctgaactggggctacaaggcggcggggagagtcgggtgcaaggagctcaagccccagtcccgtctccaacaccccccgccgcacccccaacgcaggcagatgggcctggaatacaagccattcacaccgtccaacagatatctgctatagcagccagctaagcgcagggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaag

SEQ ID NO: 201391 - DNA, 9182 bp, Homo sapiens
  Payload ID: 19746
  Gene Name: zinc finger homeobox 2
  Uniprot ID: Q9C0A1
  ENST ID: ENST00000419474
  CDS Start-End: 357-8075
ggagcgagcgagtgcccagggtgaatcaatggaaaccccctcacgaagccggggaaacacttcagccgcagccaaatagcattgattattttccttcacttccctcaccgccgtgaatttatttatttatttttttccgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaagaatcgccagtagcagcaggcgaggcagggccagattggttccctgaggggcaagaagaggatggagggctctgccccccactcaaccaaagctcacccacctccaaggaggggggcactctccctgccccagtgggctcccccgaagaccccagtgacccaccccagccctatcgcctagctgatgactacaccccagcccctgcagccttccagggcctcagcctgtccagccacatgtccctgctccactcacgcaactcctgcaagacactcaagtgtcccaagtgcaactggcactacaagtaccagcagaccctggatgtgcacatgcgagagaagcaccctgagagcaacagtcactgcagctactgcagtgctgggggcgcccacccccgccttgctcgtggagagagctacaactgtggctacaaaccctaccgctgtgacgtctgcaactactctacaaccaccaaaggcaacctcagcatccatatgcagtctgacaagcacctggccaacctacagggcttccaggcgggccctggtgggcagggaagtccaccagaggcatcactcccaccctccgcgggagacaaagagcctaagaccaaatcatcctggcagtgcaaggtgtgcagctacgagacaaacatctcccgtaacctgcgcatccatatgacctctgagaagcacatgcagaatgtcctaatgctgcaccaggggctgccgctgggcctgccacctggattgatggggccaggccctcctcccccaccaggggctacccccactagcccccctgaactcttccagtactttgggccccaggccctagggcagcctcagactcccttggctggcccggggctgaggccagacaagcccctggaagcccagctacttctcaatggtttccaccacgtaggagcacctgcccgcaagttccccacatccgcccctggaagcctatcccctgatgcccacctgcctccaagtcagctcctgggttcctcatctgacagcctgcccacctcaccacccccagacgacagcctgtccctgaaggtgttccgctgcctagtgtgccaggccttcagcacagacagcctggagctgctgctctaccactgcagcataggccggagcctcccggaagctgaatggaaggaggtggctggtgacacccaccgctgcaagctttgctgctatggcacccagctcaaggccaacttccaactccacctcaagactgacaaacatgctcagaagtaccagctggcagcccacctgcgggaggggggtggagccatgggcaccccttccccagcatccctgggagatggggctccttatgggtctgtctccccactacacctgcgctgcaacatctgtgactttgagtccaacagcaaggagaagatgcagctgcatgccaggggtgcagcccacgaagaaaacagccaaatctataagtttctgctggacatggagggagcggaggcaggggcagagctggggctataccactgcctgttgtgtgcgtgggagacaccctcccgcttggctgtgctgcaacacctgcgcacacctgcccaccgcgatgcccaggcccagaggcgtctgcagctgctacagaatggcccaaccactgaggaaggactcgcagctcttcagagcatcctgagcttcagccacgggcagctccggactcccgggaaggctcctgtcacccccttagctgagccacccacccctgagaaagatgcccagaacaagacagaacaattggcttcagaagagacagaaaacaagactggcccttccagagacagtgccaaccagaccacggtatactgctgtccatactgcagcttcctgagcccagagtccagccaggtgagggctcatacactctcccagcatgcagtgcagcccaagtacagatgcccactgtgccaggaacagctggtgggccggcctgccctgcacttccaccttagccaccttcacaacgtggtgcccgagtgcgttgagaagctgctgcttgtagctacaactgtagaaatgacatttacaaccaaagtgctgtctgcacccacattaagccctctggacaatggccaagaaccccccactcatgggccagagcctacaccgagcagagaccaggcagcagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccagctgtctttggcccccagctacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgttcggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagcccttgcccatcttcacagacacatacacccatcttggcaccctgattattcatacatgtctgcctaccacacacaaaatatatccttggttctatcttccttttcctcactgaattcccagctccccatccccataaatgcatacacatacatgcacacacacacgttatcccatgatgttccactgagaaaacaccaaaaaattttgaaaaagaagataaaaagaagaaacgaaaaagaaagcccaaggcaaagaagggggaaggaaaacaaacttcgccactctctcttctccttcctaaccctttgtctagagcaccacaccgctcacaaactctttccaaatgctcagttggctcccaaagttggagcctggcatgggcagggagcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatacagaaaaaaaaaaaaaggaagaaaactcccatcaga

SEQ ID NO: 201392 - DNA, 949 bp, Homo sapiens
  Payload ID: 19746
  Gene Name: zinc finger homeobox 2
  ENST ID: ENST00000555334
  CDS Start-End: 210-949
atacaggaatcacttgctgctttgccggggtgctgtatcacctacgggccagggcctgggtcgaattggaaatagatgtttttgagagaggatctgggagttactgtaggatttggggcttaggtctgcctagccctactctgagctgtgatcgagcgtgggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcag

SEQ ID NO: 201393 - DNA, 1972 bp, Homo sapiens
  Payload ID: 19746
  Gene Name: zinc finger homeobox 2
  ENST ID: ENST00000615307
  CDS Start-End: 266-1492
tccttcacttccctcaccgccgtgaatttatttatttatttttttccgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctggggctataccactgcctgttgtgtgcgtgggagacaccctcccgcttggctgtgctgcaacacctgcgcacacctgcccaccgcgatgcccaggcccagaggcgtctgcagctgctacagaatggcccaaccactgaggaaggactcgcagctcttcagagcatcctgagcttcagccacgggcagctccggactcccgggaaggctcctgtcacccccttagctgagccacccacccctgagaaagatgcccagaacaagacagaacaattggcttcagaagagacagaaaacaagactggcccttccagagacagtgccaaccagaccacggtcagaattggggtaactgggaagagctgaagtgggggcctggctttactgagatctgctcatattctaaaggcagacgtaattttgtcatgctttgacttatttcactcagaatagcacagttaagaaattccacccagatccagttccacatgttcagcactttcgggggcagagctggcccagcagggtcaagcacagagggagatgataggagggagacagcaggaacttgagggaaagatgaataaaggaattgtgctgagagtaggaaagagtgggggtacatgctggaaggaggggaggagaaaggcaa

SEQ ID NO: 201394 - DNA, 16064 bp, Homo sapiens
  Payload ID: 19747
  Gene Name: zinc finger homeobox 3
  Uniprot ID: Q15911
  ENST ID: ENST00000268489
  CDS Start-End: 674-11785
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggcagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatgccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcagggccaatgtggcagagggcggcaggaggctggacttcgctgacgaaagtgccaataaagacaatgccacagcaccagaaccaaatgaaagcacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctgcagaatggagggggggagcaggtcttcagccacactgccggggcggcggcggcggcggtggctgcggcggcggcggcagccaatatcagtagctcctgcggggccccctcgccgaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccacctgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggcagaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggagatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaagcgtgggttgttttcccatatacctatctatgccggtgattttacattcttgtctttttcttttcttttaatattaaaaaaaaaaaaaaagccctaaccctgttacattgtgtccttttgaaggtactattggtctgggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgttttatatattattgttttttcagtttttttttttttttttgttccagaaaagattttttgttttgttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaaaataataacccacacacacaaagagtgttgaggacttgtagcttaaaaaaaataagttttaaaaactgactttctgtatttatgatagatatgaccatttttggtgttgagtagattgttgcattggaaatgaactgaagcagtatggtagatttaaaaggaaaaaaaaaaaaaaaccttttgtgtacatttagctttttgtatggtccagctgacagctcctcatttgatgttgtcttgttcattcctagcagatgatagattgcaatccgttgattcgcctaagcttttctccccttgtcccttaattccactttctctttcttgtcccttaattccactttctctttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgtttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacagaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgtaccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaaatatgagcaaaa

SEQ ID NO: 201395 - DNA, 13841 bp, Homo sapiens
  Payload ID: 19747
  Gene Name: zinc finger homeobox 3
  Uniprot ID: Q15911
  ENST ID: ENST00000397992
  CDS Start-End: 1193-9562
aatttaaagtggtctctattcgaagtctctgctctttcacttaaacctttactctaagctgtccccctccactaatgcccccattctttggagatgctcttttcctagttaatttaaacattgctgcgtttgcttagagagagagagagagagagagagagagagagagagagaaaggggaaaataataagaaagaaaagagaagggggggaagaagaaaggaaaaaaaaaatcttaaaaagattcttagccaggttcctattgttgctcctatgcattccacttctcggtgtgtgtgtgcgtgtgtgtgtgtgtgtgtgtgtgtgcgcgcgctcgtgtgtgtgtcgtgtgtgtgtgtgtgtgtgtttttaatacatgcataaacttttggagcctctctccctcttctaggctcttctcccatcctctcttcctgctctccttgccctgctcatcactttcccctgtttttttttttttttcctcccttcctcccctctgcctccctccacctcccccttttcttttttgctgaatcttattgatccagaaggtggctaattagcccttcccgtcgtgcctgggtaatgaagcacatgcgcactgaattaatcacagccattttttgcaggaaactaattagcagaataaagatccaaagacttttttttcttttcactcatcagctcccacttccagcgcgtcccctccgaccgctgcagccgccaccgccgccgcctcctcctcctcctcctcccggccgcagccgccgccgccgcctgctttgcatcccaattacagcctagagccgctgccgccgccgccgccgcttctcttccgtggcccctgcccgctccgggggctgtaaactccccgccaaccatgctgctcggcggcagcggcggcggcggctccggctccccggctgcggccgcctcccgccccgggctccgccgagcgcgctccagctccgccgccgccgccgccgccgccgccgccgccagcagcgcgtcctccgccgccgccgacccccgccagccgccgctgctgccttgatgggctccgcggcccgagcgcctcttttcgggattaaaagcgccgccagctcccgccgccgccgccgtcgccagcagcgccgctgcagccgccgccgccggagaagcaaccgctgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggcagaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggagatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaagcgtgggttgttttcccatatacctatctatgccggtgattttacattcttgtctttttcttttcttttaatattaaaaaaaaaaaaaaagccctaaccctgttacattgtgtccttttgaaggtactattggtctgggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgttttatatattattgttttttcagtttttttttttttttttgttccagaaaagattttttgttttgttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaaaataataacccacacacacaaagagtgttgaggacttgtagcttaaaaaaaataagttttaaaaactgactttctgtatttatgatagatatgaccatttttggtgttgagtagattgttgcattggaaatgaactgaagcagtatggtagatttaaaaggaaaaaaaaaaaaaaaccttttgtgtacatttagctttttgtatggtccagctgacagctcctcatttgatgttgtcttgttcattcctagcagatgatagattgcaatccgttgattcgcctaagcttttctccccttgtcccttaattccactttctctttcttgtcccttaattccactttctctttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgtttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacagaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgtaccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaaatatgagcaaaa

SEQ ID NO: 201396 - DNA, 561 bp, Homo sapiens
  Payload ID: 19748
  Gene Name: zinc finger homeobox 4
  ENST ID: ENST00000523809
  CDS Start-End: 142-561
acggaaaccaaagctcatggaaattcctgggaaacatcacataactacagagtgcagctgaagaaattgagtgttcactgcctgataaagaaaaggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatat

SEQ ID NO: 201397 - DNA, 613 bp, Homo sapiens
  Payload ID: 19748
  Gene Name: zinc finger homeobox 4
  ENST ID: ENST00000517585
  CDS Start-End: 148-613
atagcacaatccccttgtttaaccaatacggaaaccaaagctcatggaaattcctgggaaacatcacataactacagagtgcagctgaagaaattgagtgtgtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactgggg

SEQ ID NO: 201398 - DNA, 618 bp, Homo sapiens
  Payload ID: 19748
  Gene Name: zinc finger homeobox 4
  ENST ID: ENST00000520307
  CDS Start-End: 153-618
atcgcccggcctctgggccagggacccgcgaggcggcggctgcttgctccgaacggaacgccgccgggtgtgcgttagaccagcggatagacgcccgcggcttggggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactgggg

SEQ ID NO: 201399 - DNA, 524 bp, Homo sapiens
  Payload ID: 19748
  Gene Name: zinc finger homeobox 4
  ENST ID: ENST00000523885
  CDS Start-End: 222-524
gtagtattatatttttagttgggtggatggatggaagagtgagagagaggctgcggctgccgctgccttttcgggtgttgcttagattaaggctgagacttggctgcgattgggacgcgacagtgacacgggcatcgatcgcttccattgagagcaatgcaaaaacacagcccgggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccct

SEQ ID NO: 201400 - DNA, 491 bp, Homo sapiens
  Payload ID: 19748
  Gene Name: zinc finger homeobox 4
  ENST ID: ENST00000519536
  CDS Start-End: 1-259
caagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgcatcttcttgccaaatcttctggagcgcttgtaatttcctctgtacagagcccaacaggctcatcagcagcagaagaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagag

SEQ ID NO: 201401 - DNA, 14019 bp, Homo sapiens
  Payload ID: 19748
  Gene Name: zinc finger homeobox 4
  Uniprot ID: Q86UP3
  ENST ID: ENST00000521891
  CDS Start-End: 449-11299
attcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcgtaaataatgagctgccgcctgaaatccggcttgccagtggtcagctaatgggtgatgacctgtccctccttactgcaggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaaggttatttgtaagaaagttaaaggcttgtgaacaaagaaagctaagctgttgtacatatttgtagttggctgtgcatggtacaaatttattaatatgaagaaatgcaaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttcctggatatcaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatattta

SEQ ID NO: 201402 - DNA, 12175 bp, Homo sapiens
  Payload ID: 19748
  Gene Name: zinc finger homeobox 4
  ENST ID: ENST00000518282
  CDS Start-End: 45-10817
ccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaaca

SEQ ID NO: 201403 - DNA, 989 bp, Homo sapiens
  Payload ID: 19748
  Gene Name: zinc finger homeobox 4
  ENST ID: ENST00000523625
  CDS Start-End: 1-247
caaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagcttatttatccacctactgagaacatcttggttgattccaagttttggcaattacgaataaaactactatgagcatcggtgtccaggcttttgtgtggacataaattttcaactccctttgataaatgccaaggagtacaattactagattgtatgataagagcatgtttagttttgtaaaaaccaccaaactgtcttccaaagtggttgtaccattttgcattcccaccagcgatgaatgagagttcctgttgccccacatcatcaccagcatttgatgttgtcagtgttctggattttggccattttcatagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttat

SEQ ID NO: 201404 - DNA, 4441 bp, Homo sapiens
  Payload ID: 19749
  Gene Name: zinc finger protein 10
  Uniprot ID: P21506
  ENST ID: ENST00000248211
  CDS Start-End: 223-1944
acggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaagagcaatgactttattttgcattggagaactcctggagataagctgtacaaattgaatctatgtggaaatgctttcagtcttgttactatcctattgcacattagagaattggtcctggaagggaaagaaaccacagattttatttcagtacacaaatccatcagattttcttcttttcatgaattcctacagaagtaattggcctgagagcattcttgaccaagtcttaaatgctagaatctgagaaggaattattaaataggtgagttgttgagcgagaaccccttcatttgaaaagaaatgagtatgctactatagggagagttgttgctgagaattaagaaatgatacagttaatgcaacaaaagatggaaaataatatttcagtcaatatgtcattgttttcttgactatgtctctcttctgggacatttagtagtgtttggtatgttttatgtgtctggtagaaaccatattttggttaacagcaagaaaaatgcttataatgtagtacaattaaaaacaacacatctccactaccagtgctaacccatttttaagtacatttgcatgtgggcaagaattgaaagtatacagataattgaacagaattgatttgttagataaggagattttgactgagttttatagtctgtttaatgttgctgtaataattattttaagaaacttttaaatattgtaagaggatatctagtttctctattctaccatcaaagaagcttttgagtaccacctgttaatgagctttcctattctaaattgttttgggtcacagagttccactttttccactcttattagcactgcaaaagctcctgagaatttaaaaacacagtaattctctggatgttaggacctaggggaacattgggcatttgaacatatcagggagggtccccattttagtgggaacaagtatttaaacaatatttagagcaagtgtcctcatgtgataaacagagcacagtccaaagataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccacaaaagattcaggaagaggatctattttaattttctctttcattctataaatcagtctgttgtatatagggactgaccatgattctccattttctggcataaatattagctgctcaatgattgattgttgaatgatagatgaagtattgctgaagccaaccagagatcttgatctctctctgaggaaaaaacctagaaatgatggttagaatcaggagacttgagaactacgaggaacatggcagcctctagctcatacttgtcgttgtacaattgagatcaagtgaattggccccggtctcacattttcagtgaagtcagactcagaactaggtcctgggtttcatgtttcctgctgctcttctcactgtgtacacaccatgcccacatacaacatacctatcagaaatggttttcattaagggagtagaatagtcacttaactggggctcttaacattgctaataacctgtggctcaatttcctcaactgtataatgaggttactactagtatctacctcaaagcgttgtcatgtggattgagatgatatgtatgaatcacataaaagagtgcctggcacatagtaggtgccattaataatattactattgttaacaccttaagggtctaacttgtaatgaagacagaaatatgtatgaggatgatcactgaaatatttatgacagtgcataatttgcaaaataaaaaatgtacactagcataatatttgtggcatatccgtgtaatggaagattatgcaggcattaaaatatgtacacaaaaagtttggtaaaggaaaaatgctgtcatgtgttacaaaagcatgataaataattgttaatatggaataagctcaaatatgtcaaaataaatgtaaaaaatgagtgttgcccaaaa

SEQ ID NO: 201405 - DNA, 1967 bp, Homo sapiens
  Payload ID: 19749
  Gene Name: zinc finger protein 10
  ENST ID: ENST00000402932
  CDS Start-End: 625-1944
cactttcaagctcactcttcttggcagaattcagttccttgtggctgcaggactgaggtccctgcttcctagctggctttcagctggtgctgctctttgctgctggagcctgccatgttcctcacactgcattccatcttcaagccagtaatggtgcgtcacatttttcttgggcttctatctctgacttccgttctgtgaccagctggagacaacacttgtttttttaatctgtaaagtgagactatttgattaggtcaggtttggtatttttttccgcaaaaaaaaaatttgtaatggtaggtaggatcattcagttttaaatcttcaaatgtggtgtggaactccagagattaagggggtaaaaatgcaatttatgtagctcttctcttcctaatcttggggagcttcgggcactgtagatttgcttatagaatatctctgatgttcctctgtatagtgggtgtttgtgtcatacccagctggtatgaagaagtttagactgacaatttagggagcctcccagtcatagcaaacttaacttatgtttctttctttttcccagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaa

SEQ ID NO: 201406 - DNA, 2169 bp, Homo sapiens
  Payload ID: 19749
  Gene Name: zinc finger protein 10
  Uniprot ID: P21506
  ENST ID: ENST00000426665
  CDS Start-End: 448-2169
agactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaa

SEQ ID NO: 201407 - DNA, 648 bp, Homo sapiens
  Payload ID: 19749
  Gene Name: zinc finger protein 10
  ENST ID: ENST00000540609
  CDS Start-End: 508-648
ggccacggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtggaaacattaaagaatgtgcttcagagagaaaggaaatgaaaccaaatggaaatctggatctacacaaacgagtaaacagcactggcgaatggtaactacctagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactat

SEQ ID NO: 201408 - DNA, 472 bp, Homo sapiens
  Payload ID: 19749
  Gene Name: zinc finger protein 10
  ENST ID: ENST00000536877
  CDS Start-End: 255-472
gtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagtggctgtgggagcaaagagtaagaaacactaaaacttcctggagaaattagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctg

SEQ ID NO: 201409 - DNA, 546 bp, Homo sapiens
  Payload ID: 19749
  Gene Name: zinc finger protein 10
  ENST ID: ENST00000538918
  CDS Start-End: 418-546
gtgcgtgacgtcaggccacggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatg

SEQ ID NO: 201410 - DNA, 5745 bp, Homo sapiens
  Payload ID: 19750
  Gene Name: zinc finger protein 100
  Uniprot ID: Q8IYN0
  ENST ID: ENST00000358296
  CDS Start-End: 200-1828
aatcaggcatgcagctggagcggactggacggcttccgggtttggcggggtctttgtctctcgctgtagccggagctccaggttttgctctcacttctctgtgtcttctgctcctaggggcctagcctgtgtggccctctgacctgcagatattgggagatccacagctaagacgccaggaccccctagaagcctagaaatggatgacccgaggtatggaatgtgtcctctcaagggagcaagtggatgccctggggctgagaggagtcttctggtgcagtcttattttgaaaaggggccattgacgtttagggatgtggccatagaattctctctggaggagtggcaatgcctggacagtgctcagcagggtttgtataggaaagtgatgttagagaactacagaaacctggtcttcttggcaggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaactactgtcaaaatatctttaagaaaatataagcttttaaagtgaagagtattttgaagaagaacattgtagtagaattgtaatatgtttacttgtatcacagatcttactgtacacgttttgtattagaggaaacctctgaagcagttgctcaaactttgttcaatatcagggaatttatattgaaaaaaactgtgcgaatgtaataaagttggaaaaatactttttcaaaaactacagcttagaaaacaccagagagttcatactaaaacatatttttgcagatacaggaaaaattttttaaaaattttaatcattaagtctgtaaatatcagagaatttacagtagaaatatgtaaggcactgatgcttcaggtattttactaaatcagagtgctgagtatagaaaataatctaaaactaaaattggtaaaatatttgtatataactttaaaagtagaaattttttgcagttattgcattcaaagtatgcttaactttttgaaaaaattagattttttgaaaagtgagtaataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgttaaatactattgtgcattcagtgaagtgttattatgccacagacattaacctattccaccttactcaagggtgtacgtaaaacatggtaacagtatactatttggtaacataatggattaacatctctagtaatctcttttgctagtggctttgactgcaaataagttaaagaatattatttctgtaggttaaatttttgtttttattttattttatttttgagaggtagtcttgctctgtcacccaggctggagtgcagtggcacgatctcggctcactgtaacctccacctcctgggttcacgcaattctcctgcctcagcctcctaagtagctgggattacaggcacccaccaccatgcccagctaatttttgtattttagtagagacagggtttcataatgtaagtcaagctggtctcgaactcctgaccttaaatgatttgcctgcctcggcttcccaaagttctgggattacaggcatgagccaccgtgcccagccaaatgtttattttatttaaatttatttttcttaattatttggggtacataatatgagtatatattcatgcaatatatggcatattttgatacaagaatacagtatataataatcacatcagggtaaatgaggtatccatcacctctagtatttatcctttgtattacaagcaacccagttttatacttttagttattttaaaatgtaaaattaaattgttattgattacagtgttatttttatggtcataataaaagttatgtagaagtataataaaatccctacatttctgaggcctgaataagtatttttaaagttttctaatatttattttttgagcatgtttcctgtctgcctgcaaacacatgcagacatttagttttgatttacatatagttaaatatatgttagtctaaagataaaccttaagtgtaagaaaattatagagtgagtttgtgtgtatgaatttgtacctgttttccgaagaaaaaagcaatactgaacaaaacaaatcattttaacaagatgactactagaaaactaaaagcctcaaaaatgctaaaagaaaatgtattctctgctttgtattgaatttattactgtacattctgtggcttatagttctgaatctccccatgaaaattctgtttatacttgcctggtactcatgatagacccctaattattttgtatcttttttcatataaatattttacagattatgaagtattcattatgtgagctggtctgtgattataagaataatttttacaaaatttagtgcatacaaaatttttaaatgtaattccacaattagtgtattaagttacattttatttagttagaacacttcattttgtttttagttggagaactctatagccctttagttatttttcttttcactttttatagttgacataagtaaatttatttattgagtcaatttgttcaggtaagtactagggaagctttataagtcgtgaggatgtttttatatttaaatgtagcaaacatacatgacagttcttgctgtgtaacagatgctccatagtaagccataagtattcctgctaaagttagcttgtaacttcagttcagagatggaaaacatcagtggtgaagaaataaaattgattcttcatgtggagaggacatagtttccaggctgcaatgctgaatcttgctgaatttaaagagaagttctgcatcttttatttcttaattatcttcagatttctctgtatttattatgtgtatccccagctatgtatgcagcacagcccatctcctttttctgtgttatggcttcagttttctcactgttgtcttaatgccatttcatttcacatggtactttgtaaattttgacgagaaagttggttgtttttttttttttttttttttttgagacagagtctcactcttgttgcccaagctggagtgcagtggtgcaatgtgggctcactgcaacctctgccttccaggttcaagcaattatcctgcctcagcctcccaagtagctgggattacaggcacctgccaccacatctggctgaatttttttttttttaattttttgtagagacgaagtttcaccatgttggccaggctggtttcaaactcctgacctcatatgatccacctgcctcagcctcccaaagtgcttggattacaggcataagccactgcacccagctgaaagttggtattttttaatgcactgaataattgtttttaactggagagtttggttatcaatataactttcggattagttaagataaaagcatacattgtccacaggtgagaagattaaatcagaatagttgttctttgttaaaaaaaaaattagattcttaaagtgtggcaaacataaaatttgcaagaaaatgtagaaattaaatttttaagagttaatggtaagtgaacaattttaaatttattttttattatgtaacatacttttattaaaatatatacttatataataaaagtataaca

SEQ ID NO: 201411 - DNA, 2283 bp, Homo sapiens
  Payload ID: 19750
  Gene Name: zinc finger protein 100
  ENST ID: ENST00000305570
  CDS Start-End: 357-1793
agcagccgcccctcccccaacaatggcgcagcccaggctgcacccgcgcaagcaggtgcctcctcgctggcagttcacccgcccaccccgcgacccgccccgggcagggctccggcctccctgcacgctcgccgcgctgccgctgcctccgcctccccaagctgactcatctggagataattatgtgtttttctctttcgttctctttatgtgatggattacatttattgatttacatatgttgaaccagccttgcatcccaggggccattgacgtttagggatgtggccatagaattctctctggaggagtggcaatgcctggacagtgctcagcagggtttgtataggaaagtgatgttagagaactacagaaacctggtcttcttgggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaa

SEQ ID NO: 201412 - DNA, 588 bp, Homo sapiens
  Payload ID: 19750
  Gene Name: zinc finger protein 100
  ENST ID: ENST00000598026
  CDS Start-End: 121-588
aggttttgctctcacttctctgtgtcttctgctcctaggggcctagcctgtgtggccctctgacctgcagatattgggagatccacagctaagacgccaggaccccctagaagcctagaaatggatgacccgaggtatggaatgtgtcctctcaagggagcaagtggatgccctggggctgagaggagtcttctggtgcagtcttattttgaaaaggggccattgacgtttagggatgtggccatagaattctctctggaggagtggcaatgcctggacagtgctcagcagggtttgtataggaaagtgatgttagagaactacagaaacctggtcttcttggcaggtattgctctcactaagccagacctgatcacctgtctggagcaaggaaaagagccctggaatataaagagacatgagatggtagccaaacccccagacggagtctcgctctgtcatcaagttggagtgcagtggcgcgatcttggttcactgcaacctccacctcctgggttcaagcaatcttcctgcctcagcctcctgagtagctgcgactacaggcacatgccaccacgccaagctaat

SEQ ID NO: 201413 - DNA, 548 bp, Homo sapiens
  Payload ID: 19750
  Gene Name: zinc finger protein 100
  ENST ID: ENST00000594401
  CDS Start-End: 360-548
agttcacccgcccaccccgcgacccgccccgggcagggctccggcctccctgcacgctcgccgcgctgccgctgcctccgcctccccaagctgactcatctggagataattatgtgtttttctctttcgttctctttatgtgatggattacatttattgatttacatatgttgaaccagccttgcatcccagagaatttcatctgaaaaggattccaagagaagaaggagaaagaggaaaaatgatgtttttttttcttcagctaagggccattgacgtttagggatgtggccatagaattctctctggaggagtggcaatgcctggacagtgctcagcagggtttgtataggaaagtgatgttagagaactacagaaacctggtcttcttgggtattgctctcactaagccagacctgatcacctgtctggagcaaggaaaagagccctggaatataaagagacatgagatggtagccaaacccccagttatatgttctcattttccccaagacctttgggcagagcaggacattaaagattctttt

SEQ ID NO: 201414 - DNA, 1840 bp, Homo sapiens
  Payload ID: 19750
  Gene Name: zinc finger protein 100
  ENST ID: ENST00000608416
  CDS Start-End: 70-1770
gtggccctctgacctgcagatattgggagatccacagctaagacgccaggaccccctagaagcctagaaatggtggacccgaggtatggaatgtgtcctctcaagggagcaagtggatgccctggggctgagaggagtcttctggtgcagtcttattttgaaaaggggccattgacgtttagggatgtggccatagaattctctctggaggagtggcaatgcctggacagtgctcagcagggtttgtataggaaagtgatgttagagaactacagaaacctggtcttcttgggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaaataactcatactggagagaaaccctacaaatgtgaaaaatgtggcaaagccttttaccagtcctcaactcttactaaacataaaaattcatactggagggaactcctgctgtgaagaatatggcaaagcctttaataaattctcaattcctaacagacataagataattcatactagagagaaa

SEQ ID NO: 201415 - DNA, 5643 bp, Homo sapiens
  Payload ID: 19750
  Gene Name: zinc finger protein 100
  Uniprot ID: Q8IYN0
  ENST ID: ENST00000614218
  CDS Start-End: 98-1726
gtcttctgctcctaggggcctagcctgtgtggccctctgacctgcagatattgggagatccacagctaagacgccaggaccccctagaagcctagaaatggatgacccgaggtatggaatgtgtcctctcaagggagcaagtggatgccctggggctgagaggagtcttctggtgcagtcttattttgaaaaggggccattgacgtttagggatgtggccatagaattctctctggaggagtggcaatgcctggacagtgctcagcagggtttgtataggaaagtgatgttagagaactacagaaacctggtcttcttggcaggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaactactgtcaaaatatctttaagaaaatataagcttttaaagtgaagagtattttgaagaagaacattgtagtagaattgtaatatgtttacttgtatcacagatcttactgtacacgttttgtattagaggaaacctctgaagcagttgctcaaactttgttcaatatcagggaatttatattgaaaaaaactgtgcgaatgtaataaagttggaaaaatactttttcaaaaactacagcttagaaaacaccagagagttcatactaaaacatatttttgcagatacaggaaaaattttttaaaaattttaatcattaagtctgtaaatatcagagaatttacagtagaaatatgtaaggcactgatgcttcaggtattttactaaatcagagtgctgagtatagaaaataatctaaaactaaaattggtaaaatatttgtatataactttaaaagtagaaattttttgcagttattgcattcaaagtatgcttaactttttgaaaaaattagattttttgaaaagtgagtaataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgttaaatactattgtgcattcagtgaagtgttattatgccacagacattaacctattccaccttactcaagggtgtacgtaaaacatggtaacagtatactatttggtaacataatggattaacatctctagtaatctcttttgctagtggctttgactgcaaataagttaaagaatattatttctgtaggttaaatttttgtttttattttattttatttttgagaggtagtcttgctctgtcacccaggctggagtgcagtggcacgatctcggctcactgtaacctccacctcctgggttcacgcaattctcctgcctcagcctcctaagtagctgggattacaggcacccaccaccatgcccagctaatttttgtattttagtagagacagggtttcataatgtaagtcaagctggtctcgaactcctgaccttaaatgatttgcctgcctcggcttcccaaagttctgggattacaggcatgagccaccgtgcccagccaaatgtttattttatttaaatttatttttcttaattatttggggtacataatatgagtatatattcatgcaatatatggcatattttgatacaagaatacagtatataataatcacatcagggtaaatgaggtatccatcacctctagtatttatcctttgtattacaagcaacccagttttatacttttagttattttaaaatgtaaaattaaattgttattgattacagtgttatttttatggtcataataaaagttatgtagaagtataataaaatccctacatttctgaggcctgaataagtatttttaaagttttctaatatttattttttgagcatgtttcctgtctgcctgcaaacacatgcagacatttagttttgatttacatatagttaaatatatgttagtctaaagataaaccttaagtgtaagaaaattatagagtgagtttgtgtgtatgaatttgtacctgttttccgaagaaaaaagcaatactgaacaaaacaaatcattttaacaagatgactactagaaaactaaaagcctcaaaaatgctaaaagaaaatgtattctctgctttgtattgaatttattactgtacattctgtggcttatagttctgaatctccccatgaaaattctgtttatacttgcctggtactcatgatagacccctaattattttgtatcttttttcatataaatattttacagattatgaagtattcattatgtgagctggtctgtgattataagaataatttttacaaaatttagtgcatacaaaatttttaaatgtaattccacaattagtgtattaagttacattttatttagttagaacacttcattttgtttttagttggagaactctatagccctttagttatttttcttttcactttttatagttgacataagtaaatttatttattgagtcaatttgttcaggtaagtactagggaagctttataagtcgtgaggatgtttttatatttaaatgtagcaaacatacatgacagttcttgctgtgtaacagatgctccatagtaagccataagtattcctgctaaagttagcttgtaacttcagttcagagatggaaaacatcagtggtgaagaaataaaattgattcttcatgtggagaggacatagtttccaggctgcaatgctgaatcttgctgaatttaaagagaagttctgcatcttttatttcttaattatcttcagatttctctgtatttattatgtgtatccccagctatgtatgcagcacagcccatctcctttttctgtgttatggcttcagttttctcactgttgtcttaatgccatttcatttcacatggtactttgtaaattttgacgagaaagttggttgtttttttttttttttttttttttgagacagagtctcactcttgttgcccaagctggagtgcagtggtgcaatgtgggctcactgcaacctctgccttccaggttcaagcaattatcctgcctcagcctcccaagtagctgggattacaggcacctgccaccacatctggctgaatttttttttttttaattttttgtagagacgaagtttcaccatgttggccaggctggtttcaaactcctgacctcatatgatccacctgcctcagcctcccaaagtgcttggattacaggcataagccactgcacccagctgaaagttggtattttttaatgcactgaataattgtttttaactggagagtttggttatcaatataactttcggattagttaagataaaagcatacattgtccacaggtgagaagattaaatcagaatagttgttctttgttaaaaaaaaaattagattcttaaagtgtggcaaacataaaatttgcaagaaaatgtagaaattaaatttttaagagttaatggtaagtgaacaattttaaatttattttttattatgtaacatacttttattaaaatatatacttatataataaaagtataaca

SEQ ID NO: 201416 - DNA, 2283 bp, Homo sapiens; identical to SEQ ID NO: 201411
  Payload ID: 19750
  Gene Name: zinc finger protein 100
  ENST ID: ENST00000624316
  CDS Start-End: 357-1793

SEQ ID NO: 201417 - DNA, 588 bp, Homo sapiens; identical to SEQ ID NO: 201412
  Payload ID: 19750
  Gene Name: zinc finger protein 100
  ENST ID: ENST00000624841
  CDS Start-End: 121-588

SEQ ID NO: 201418 - DNA, 548 bp, Homo sapiens; identical to SEQ ID NO: 201413
  Payload ID: 19750
  Gene Name: zinc finger protein 100
  ENST ID: ENST00000623758
  CDS Start-End: 360-548

SEQ ID NO: 201419 - DNA, 1830 bp, Homo sapiens
  Payload ID: 19751
  Gene Name: zinc finger protein 101
  Uniprot ID: Q8IZC7
  ENST ID: ENST00000318110
  CDS Start-End: 169-1479
aacttccaaagcccgaagcggtctcatttcccgccggccccccattcgggtccgggttttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcgcgccgctgcactccagcctggtgacagagcgagacttcgtctcaaaacaaacaaaaaaaagaaggccccatatctcc

SEQ ID NO: 201420 - DNA, 1552 bp, Homo sapiens
  Payload ID: 19751
  Gene Name: zinc finger protein 101
  Uniprot ID: Q8IZC7
  ENST ID: ENST00000415784
  CDS Start-End: 573-1523
cgtgtgggacctgttctggctgctccagccccaggaaggacccaggacacccggaagccggaaatgacaaagtcttgccctgttgcccaggctggagtgcaatggtacaatcttggctcactacaacctccgctaaagtgattctcctgcctcagccctcccccacgcccggtagctgaacccggtagctgaatcctgagtagctgggattacaggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggcccc

SEQ ID NO: 201421 - DNA, 1152 bp, Homo sapiens
  Payload ID: 19751
  Gene Name: zinc finger protein 101
  ENST ID: ENST00000444249
  CDS Start-End: 114-299
gttttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaa

SEQ ID NO: 201422 - DNA, 581 bp, Homo sapiens
  Payload ID: 19751
  Gene Name: zinc finger protein 101
  ENST ID: ENST00000585565
  CDS Start-End: 1-442
actcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggctggtcttgaactcctgacctcaaggaatccatcctcttcagcctcgcaaagt

SEQ ID NO: 201423 - DNA, 575 bp, Homo sapiens
  Payload ID: 19751
  Gene Name: zinc finger protein 101
  ENST ID: ENST00000541458
  CDS Start-End: 402-575
aacttccaaagcccgaagcggtctcatttcccgccggccccccattcgggtccgggttttagttcctcggggagcccctggtgccccggatacggctgattttgtcgtgtgggacctgttctggctgctccagccccaggaaggacccaggacacccggaagccggaaatggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagccttt

SEQ ID NO: 201424 - DNA, 4627 bp, Homo sapiens
  Payload ID: 19751
  Gene Name: zinc finger protein 101
  Uniprot ID: Q8IZC7
  ENST ID: ENST00000592502
  CDS Start-End: 111-1421
ttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcacgccattgcactccagcctgggcgacaaaagtgagactccatcacacacacacacaaaaaagccccatatcacgtggtggctcatgcctgtaaaaccagcactttgggaagccgaggtgggtggatcacgaggtccagagatggagactatcttggccaacatggtgaaaccccgtctctactaaaaatacaaaaattagccaggcgtggtggtgtgtgcctgtagtcccagctactcgggaggctgaggcaggagaattgcttgaaccagggacttggaggttgcagtgagccgagatcgcgccgctgcactccagcctggtgacagagcgagacttcgtctcaaaacaaacaaaaaaaagaaggccccatatctccaaagaaaaaaaaaattaactgggtgaggtggtgcatccctgtagttctagctgctcagaaagctgaggtgggaggaacccttgagcctgggaggttgaggctgcagtgagctgagatcgtgccactacactccagcctggatgacggtgacactctgtctcagaaaaaaagggaaagaaataattctcatttatacaggagagaaatcctatgaatgtaaggaatatgggaatacattcagtttccaaagatatgaaaagactaactggaaaaaaatccaaagacctcagatattccagttctattcagagccataaaaggactcatactggagaaaaattgtagaaatgtacagaatatggggaaactctcattgctctcatctccattcaaagacacgtgtcagtgcacactggagatggatggtatgaatcgaagaatacacactggatggaaacgttagtagtttggaaaatacaggaaacttccattttaacaataattaaaattcacatgggctgtgcacagtggctctcccctgtaatcccagcattttgggaggctggggtgggtagattgcttgaggccaggtattcaagaccagcctggcaacctggagaaatcccatgtatacaaaaaatagaaaagttagccagggatgatggtgttcgcctgtagtcccagctactcaggaagctgaggtgggaggattgcttgagtttgggaggtcgaggttgcagtgagtggagattgcgccactggactccagcctgggcaacagtgagaccctgtctaaaaaaattaatcatgtgagaacatccactcgaaagaaatcctataaacgtaagtaattttgaaagcctgatgcaaattaattattatataatgctcaaaaacttaatcatgaatgagttattacacaaagttataaatatatagcatttatcagtggctcattcttttttctttcttttttttttttttttttgagatggagttttgccctgtcgcccaggctggagtgcagtggcacaatctcggctcactgcaacctccgcctcctgggtgtgagcaattttcctgcctcagcctcctgagtaactgggattataagcacatgccaccacgcctggctaatttttttgtatttttagtagagacggggcttcaccatgtggttcaggctggtctcagactcctgaccttgtgatccgccctccttggcctcccaaagtgctgagattacaggtgtgagccaccgcgcctggccttttttttttttcccgagacacagtctcactctgttgcccaggctagagtgcagtggcgcgatcttgactcactgtaacctctgacttctgggttcaagcaattctcctgcttcagtctccgaagcatctgggattacaggcgcacgccaccatgcccagctaaatttttggtatttttgtagaaacagggtttttccacattggccaggctggtcttgaactcctgacctcaaggaatccatcctcttcagcctcgcaaagtgctgagattataggcatgagacaccttgcccggcccctgtgactcattcttaaaaaggatctttggattatgggtttccacttttgcaaggaaatgtgagaatgatactctttaagcagtggtacctgaggtttaataggaagtgtttttatcctaagttagttaataaaatttttttctatccattttggttttcatttttttctatccattttaaagtgttggatctgtgggtgaagtgaaatttatttctaatatgtaagcaggtttaatttttatgtagtgtttaattgttctgtgatgaatgggccattacaaaatgagtctatttttgtttgttttcttttgtttttgagactgagtcttgctctgtcgccaggctgaagtgtagtggcgcgatcttggctcactgcaacctccacctcccgggttcaagtaatccccctgccttagcctcctacaggcgcgtgccgacatgcctggctaattttttgtattttagtagagacggggtttcattgtactggccaggatggtcttgatttcctgaccttgtgatccaccccaccttggcctcccaaagtgctgagattacaggagtgagccactgcgaccggcccatgagtctttattaatagagatttcttactggtgttatgtggcagattctgcatattcctcacccatcatatgtattccactttcctttattatggggaaaactactctttttggcatgatacaatgttgactccattttctttgctaataaggacttggtatcaatttatcagtatgtaaagtttaccatagagtattgtctcatgtgaatcattcccattttttgctctttactctttgtcgttatttctgagtattatttggatggttcattttgacttaaggatagccctgtgatatgacaatatttttatctaatctgatggagaaagcatttagtctcctgatcaagtatgatgttagctgcaggtttttaataaatgccttaattcagtttgaa

SEQ ID NO: 201425 - DNA, 10460 bp, Homo sapiens
  Payload ID: 19752
  Gene Name: zinc finger protein 106
  Uniprot ID: Q9H2Y7
  ENST ID: ENST00000263805
  CDS Start-End: 328-5979
gagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattga

SEQ ID NO: 201426 - DNA, 719 bp, Homo sapiens
  Payload ID: 19752
  Gene Name: zinc finger protein 106
  ENST ID: ENST00000567041
  CDS Start-End: 115-719
atctttgagagtaagattaaggcatcttattgagaagtttgagatatccgtggcttttagcaacttgagactgtcatcctagctgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatag

SEQ ID NO: 201427 - DNA, 3191 bp, Homo sapiens
  Payload ID: 19752
  Gene Name: zinc finger protein 106
  ENST ID: ENST00000565948
  CDS Start-End: 744-3191
gtaagcgctgtcaccaggccttctgagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgag

SEQ ID NO: 201428 - DNA, 5677 bp, Homo sapiens
  Payload ID: 19752
  Gene Name: zinc finger protein 106
  Uniprot ID: Q9H2Y7
  ENST ID: ENST00000565380
  CDS Start-End: 159-3494
gcccggcggggagcgggtccggagcaggctcccggacccaaaactgaagggggcgtctgaggcgtcagggagctccctcgcctggctctcggcggcctgatggagtaagaggggttggctgtgaatctgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaaga

SEQ ID NO: 201429 - DNA, 788 bp, Homo sapiens
  Payload ID: 19752
  Gene Name: zinc finger protein 106
  ENST ID: ENST00000569648
  CDS Start-End: 1-654
gaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttgggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaata

SEQ ID NO: 201430 - DNA, 4733 bp, Homo sapiens
  Payload ID: 19752
  Gene Name: zinc finger protein 106
  ENST ID: ENST00000565500
  CDS Start-End: 1-2552
ctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaataaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaa

SEQ ID NO: 201431 - DNA, 1470 bp, Homo sapiens
  Payload ID: 19752
  Gene Name: zinc finger protein 106
  ENST ID: ENST00000564754
  CDS Start-End: 177-1470
ggcggcggctgtggcggggcccggcggggagcgggtccggagcaggctcccggacccaaaactgaagggggcgtctgaggcgtcagggagctccctcgcctggctctcggcggcctgatggagtaagaggggttggctgtgaatctgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaa

SEQ ID NO: 201432 - DNA, 5081 bp, Homo sapiens
  Payload ID: 19752
  Gene Name: zinc finger protein 106
  ENST ID: ENST00000565611
  CDS Start-End: 311-3517
ggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaa

SEQ ID NO: 201433 - DNA, 900 bp, Homo sapiens
  Payload ID: 19752
  Gene Name: zinc finger protein 106
  ENST ID: ENST00000567772
  CDS Start-End: 1-576
ggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagtatgtaagcttttctctgggttaagggcatcccagtagtgagactggggcatttttatatgagtgatataagccatacttgctcattaaaactaaaatgagcaagtacaactaatttgtcactggaattctcttcatatatacaggaggattcttttaaaatattttagagaatgtaatttaaatatcagtcattttctttcatttcctctaatctagggttagagttgactttgtattagcacccacaaggttccatttattaggataagtacaaaatttgtttcgtgtgaaataaatggggttgaagttaattcagccaattttctgaa

SEQ ID NO: 201434 - DNA, 5174 bp, Homo sapiens
  Payload ID: 19753
  Gene Name: zinc finger protein 107
  Uniprot ID: Q9UII5
  ENST ID: ENST00000344930
  CDS Start-End: 453-2804
tagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaa

SEQ ID NO: 201435 - DNA, 1061 bp, Homo sapiens
  Payload ID: 19753
  Gene Name: zinc finger protein 107
  ENST ID: ENST00000360117
  CDS Start-End: 787-1061
gcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgatggagtctcgctctgttgctcaggctgaagggcagtggtgcgatctcggctcactgaaacctccgccttccgggctcaagcaattctcctgcctcaacctcgcaagtagctgggattacaggcatgcaccaccatgcccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaa

SEQ ID NO: 201436 - DNA, 6094 bp, Homo sapiens
  Payload ID: 19753
  Gene Name: zinc finger protein 107
  Uniprot ID: Q9UII5
  ENST ID: ENST00000395391
  CDS Start-End: 1376-3727
catcttaaagcttccctttgagagtgttgctcttagaacttttcagatcttgttcagtgacctgctacagttatgtgagaggatccaggtgtaaatagaatctgatgacagattctgtaagcgtaaacaagcatcttaggggtgagagatgaaggccacaaagtatcgagagtcatgatcacaattatacctacccgtaaaatgtaatactggactagagtattttttctttccttttgcccaagagctagctaattaggacccgtaatctggagctccactgtggcagttccactttctatttagaatcagcctgagtctctcctgcctgccttatccttggccatcagcccagggtcactgggaactctctcacaatcacctaggcatctttgagatatttgaggatgtccagagcagaattgtgtcaggttgacaagagtggttaattctgcctctgtctcagtgtaagagaaatgagacatcctgtgtttgctcctcccctcatacaagagatgtctttggttggtatccagttgagagtttcccagtttcctgatagttggatgaaaaacaaggaggaggtctggagactcaagcagataaactaattgctaccatttcatatggcccttagaaaaatagataaagcagtcatggtccctaccatctaggaactgttagtctagactagcaactgaatacgtggttgaattaagcatcatatggttggcaaagtgaatagatgtgtgggaaaacgtgtgggctttatttgggccactttctttatatcgttgtgacttctgaggtcatcatttgaatgaatgtttatgaccacaagagttttaaatatttttatttcttttactttgctaagaatacatatttatcttataataaaattaccctagaaaaccccaggagatttgtttaaatggctaattagtatatttacacagttgatgggttgagcagagtaatatatagggtttactcccagctgcagttctgttcagattcaccctttttggaggctttatttaggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaa

SEQ ID NO: 201437 - DNA, 5773 bp, Homo sapiens
  Payload ID: 19753
  Gene Name: zinc finger protein 107
  Uniprot ID: Q9UII5
  ENST ID: ENST00000423627
  CDS Start-End: 496-2847
ccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaatttttggattatgcgtgaacttagttttttaattaaactttttttaacatgttaaaactattgtgcattcaatgaagtgttttcatgccactgactttacctatcccacattactcaagggtttaggtaaaagagggtaacagtatactacttgataacataatgggctaacatctctaataattatttttgctagtgactttaaactgctaataaagaatattgttcccataggttagatttttattctttttaaaatttaaacttatttctcttaatttttgtggatacatagtatgtgtatatctttatgccatgtatggcatattttgatacaggcatataattttatgtattaatcacatcagggcaaaagatgtatccatcaactccagcatttctcctttgtattacaaaccaattctgcacttttagatactttagaatgtacagtcgttactacagggtcattttatggttataataaaaattatatacaagtataaataaaccatgagaaaattctgagttctgaataaacatttaaaaaatgtta

SEQ ID NO: 201438 - DNA, 5589 bp, Homo sapiens
  Payload ID: 19753
  Gene Name: zinc finger protein 107
  ENST ID: ENST00000613690
  CDS Start-End: 201-2663
aatcaggcacgcagctggagcggacaggacggcttccgggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatggaaccactgacatttaaagatgtcgccatagaattctctctggaggagtggcaatgcctggatactgcacagcgggatttatataggaatgtgttgttagagaactacagaaacctggtctttttggtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaatttttggattatgcgtgaacttagttttttaattaaactttttttaacatgttaaaactattgtgcattcaatgaagtgttttcatgccactgactttacctatcccacattactcaagggtttaggtaaaagagggtaacagtatactacttgataacataatgggctaacatctctaataattatttttgctagtgactttaaactgctaataaagaatattgttcccataggttagatttttattctttttaaaatttaaacttatttctcttaatttttgtggatacatagtatgtgtatatctttatgccatgtatggcatattttgatacaggcatataattttatgtattaatcacatcagggcaaaagatgtatccatcaactccagcatttctcctttgtattacaaaccaattctgcacttttagatactttagaatgtacagtcgttactacagggtcattttatggttataataaaaattatatacaagtataaataaaccatgagaaaattctgagttctgaataaacatttaaaaaatgtta

SEQ ID NO: 201439 - DNA, 5685 bp, Homo sapiens
  Payload ID: 19753
  Gene Name: zinc finger protein 107
  ENST ID: ENST00000620827
  CDS Start-End: 201-2759
aatcaggcacgcagctggagcggacaggacggcttccgggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaatttttggattatgcgtgaacttagttttttaattaaactttttttaacatgttaaaactattgtgcattcaatgaagtgttttcatgccactgactttacctatcccacattactcaagggtttaggtaaaagagggtaacagtatactacttgataacataatgggctaacatctctaataattatttttgctagtgactttaaactgctaataaagaatattgttcccataggttagatttttattctttttaaaatttaaacttatttctcttaatttttgtggatacatagtatgtgtatatctttatgccatgtatggcatattttgatacaggcatataattttatgtattaatcacatcagggcaaaagatgtatccatcaactccagcatttctcctttgtattacaaaccaattctgcacttttagatactttagaatgtacagtcgttactacagggtcattttatggttataataaaaattatatacaagtataaataaaccatgagaaaattctgagttctgaataaacatttaaaaaatgtta

SEQ ID NO: 201440 - DNA, 3321 bp, Homo sapiens
  Payload ID: 19754
  Gene Name: zinc finger protein 112
  Uniprot ID: Q9UJU3
  ENST ID: ENST00000337401
  CDS Start-End: 90-2831
agagccacttccgccccaggtacgctaggccgcggccttcgttcctcccagaaaggtctctgcctttctctagaaaaagaaagagaaaaatgaccaaattccaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagt

SEQ ID NO: 201441 - DNA, 3654 bp, Homo sapiens
  Payload ID: 19754
  Gene Name: zinc finger protein 112
  Uniprot ID: Q9UJU3
  ENST ID: ENST00000354340
  CDS Start-End: 53-2776
acttccgccccaggtacgctaggccgcggccttcgttcctcccagaaaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcacttgaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaa

SEQ ID NO: 201442 - DNA, 534 bp, Homo sapiens
  Payload ID: 19754
  Gene Name: zinc finger protein 112
  ENST ID: ENST00000592151
  CDS Start-End: 84-248
acttccgccccaggtacgctaggccgcggccttcgttcctcccagaaaggtctctgcctttctctagaaaaagaaagagaaaaatgaccaaattccaggagatggtgacattcaaggatgttgctgtggtcttcactgaggaggagctggggctgctggactctgtccagaggaagctgtaccgagatgtgatgctggagaacttcaggaacctgctcttacacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttc

SEQ ID NO: 201443 - DNA, 569 bp, Homo sapiens
  Payload ID: 19754
  Gene Name: zinc finger protein 112
  ENST ID: ENST00000587909
  CDS Start-End: 117-569
gcagagccacttccgccccaggtacgctaggccgcggccttcgttcctcccagaaagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacat

SEQ ID NO: 201444 - DNA, 577 bp, Homo sapiens
  Payload ID: 19754
  Gene Name: zinc finger protein 112
  ENST ID: ENST00000590687
  CDS Start-End: 129-577
atcattcctttcaggaagttgagtgaggcctgagacagcaatgtttcgtttagcctggcggcggccctccttgtcttcgagaagagcatccgcggctagcagtggaagatggggttgggccccaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaa

SEQ ID NO: 201445 - DNA, 558 bp, Homo sapiens
  Payload ID: 19754
  Gene Name: zinc finger protein 112
  ENST ID: ENST00000588057
  CDS Start-End: 121-558
gaaagtgaggtcatcattcctttcaggaagttgagtgaggcctgagacagcaatgtttcgtttagcctggcggcggccctccttgtcttcgagaagagcatccgcggctagcagtggaagatggggttgggccccaggtctctgcctttctctagaaaaagaaagagaaaaatgaccaaattccaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaag

SEQ ID NO: 201446 - DNA, 2206 bp, Homo sapiens
  Payload ID: 19755
  Gene Name: zinc finger protein 114
  Uniprot ID: Q8NC26
  ENST ID: ENST00000315849
  CDS Start-End: 225-1478
acagcgaggacccaaggctggggtttcctgcttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctacgaatgtgaagaatgtgggaaagtcattcgggagtcctcaaaatatacacatataaggagccacactggagagaaaccctataaatgtaagacatgtggaaaagactttgcaaagtcgtcaggacttaaaaaacatcttaagactcacaaagatgagaagccctgtgaatgaaaggaaggtggaaaatttttcattaattttctgactgtaccaaacatgtgaggaggacatattggaagggagctcaaggggttagcatgagtgagaacatcttccctgaactctcgtatcttacagaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacctgccggccgcggtggctcatgcctgtaatcccagcactttgggaggccgaggcgggcggatcacgaggtcaggagatcaagaccatcctggctaacacggtgataccccgtctctactaaaaatacaaaaaaaattagccaggcgtggtggcaggtgcctgtagtcccagctacttgggaggctgaggtaggagaatggtgtaaacctgggaggtggagcttgcagtgagccgagatggagccactgcactccagcctgggggaaagagcgagactccgtctcaaaaaaaaaaaaaagtaggaaagacctctttaaacacttaccactcatgttgcatgtgaatccacatcctgaagggaggctacaactggaataaaaataagaaagctttc

SEQ ID NO: 201447 - DNA, 569 bp, Homo sapiens
  Payload ID: 19755
  Gene Name: zinc finger protein 114
  ENST ID: ENST00000594024
  CDS Start-End: 228-569
aggaacggtggcgcgggcggaggcgacagcgaggacccaaggctggggtttcctgcttggatcaggagtgcctggggactccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccagggtcttgctctgttgcccaggctggactgcagtgggaggatcatagcttattgcaacctccacctcccaggctcaggcaatcctccctcctcagcctcccgggtagctgagactacaggcacccgcccacactcacgggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacattt

SEQ ID NO: 201448 - DNA, 2478 bp, Homo sapiens
  Payload ID: 19755
  Gene Name: zinc finger protein 114
  Uniprot ID: Q8NC26
  ENST ID: ENST00000595607
  CDS Start-End: 495-1748
agcccacttgcacccaagtgaataaacagcctttgttgcttacacaaagcctgtttaggtggtcttctatacggacacgcgtgacacccaggagttcgagacgagtctgggcagcatatactgaggggaaaaaaaagccttctttccttgggaaatgcaggaagccagcaagcggccggagtctccggagcccgcaaggaggcgcgttggctgcgcagagagcgcgcttcccagctggagagcctaggaacggtggcgcgggcggaggcgacagcgaggacccaaggctggggtttcctgcttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctacgaatgtgaagaatgtgggaaagtcattcgggagtcctcaaaatatacacatataaggagccacactggagagaaaccctataaatgtaagacatgtggaaaagactttgcaaagtcgtcaggacttaaaaaacatcttaagactcacaaagatgagaagccctgtgaatgaaaggaaggtggaaaatttttcattaattttctgactgtaccaaacatgtgaggaggacatattggaagggagctcaaggggttagcatgagtgagaacatcttccctgaactctcgtatcttacagaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacctgccggccgcggtggctcatgcctgtaatcccagcactttgggaggccgaggcgggcggatcacgaggtcaggagatcaagaccatcctggctaacacggtgataccccgtctctactaaaaatacaaaaaaaattagccaggcgtggtggcaggtgcctgtagtcccagctacttgggaggctgaggtaggagaatggtgtaaacctgggaggtggagcttgcagtgagccgagatggagccactgcactccagcctgggggaaagagcgagactccgtctcaaaaaaaaaaaaaagtaggaaagacctctttaaacacttaccactcatgttgcatgtgaatccacatcctgaagggaggctacaactggaataaaaataagaaagctttcaa

SEQ ID NO: 201449 - DNA, 457 bp, Homo sapiens
  Payload ID: 19755
  Gene Name: zinc finger protein 114
  ENST ID: ENST00000601320
  CDS Start-End: 276-457
attttgaggaaggggtcaagaagcgagtacaaaatgtctgggcaggacgaatctctgtagtcggtccttcctggcggcctcgttaggttgatttatttcaacagtttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccagggtcttgctctgttgcccaggctggactgcagtgggaggatcatagcttattgcaacctccacctcccaggctcaggcaatcctccctcctcagcctcccgggtagctgagactacaggcacccgcccacactcacgggactcggtgaccttcgcagacgtggctgtgaactt

SEQ ID NO: 201450 - DNA, 634 bp, Homo sapiens
  Payload ID: 19755
  Gene Name: zinc finger protein 114
  ENST ID: ENST00000595408
  CDS Start-End: 240-634
gcgcgggcggaggcgacagcgaggacccaaggctggggtttcctgcttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccagggtcttgctctgttgcccaggctggactgcagtgggaggatcatagcttattgcaacctccacctcccaggctcaggcaatcctccctcctcagcctcccgggtagctgagactacaggcacccgcccacactcacgggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacatt

SEQ ID NO: 201451 - DNA, 1742 bp, Homo sapiens
  Payload ID: 19755
  Gene Name: zinc finger protein 114
  Uniprot ID: Q8NC26
  ENST ID: ENST00000600687
  CDS Start-End: 297-1550
aaaaaaaaaaaagaaagaaagaaaagaaaggaaggaaggaagaaaaaaatcatttcaagggtaggaagccagcaagcggccggagtctccggagcccgcaaggaggcgcgttggctgcgcagagagcgcgcttcccagctggagagcctaggaacggtggcgcgggcggaggcgacagcgaggacccaaggctggggtttcctgcttggatcaggagtgcctggggactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctacgaatgtgaagaatgtgggaaagtcattcgggagtcctcaaaatatacacatataaggagccacactggagagaaaccctataaatgtaagacatgtggaaaagactttgcaaagtcgtcaggacttaaaaaacatcttaagactcacaaagatgagaagccctgtgaatgaaaggaaggtggaaaatttttcattaattttctgactgtaccaaacatgtgaggaggacatattggaagggagctcaaggggttagcatgagtgagaacatcttccctgaactctcgtatcttacagaaatgtgaaaaaaaaccctgtgaaggtaaagtctacagaaagcctttcatcttcattcatcttgag

SEQ ID NO: 201452 - DNA, 2105 bp, Homo sapiens
  Payload ID: 19755
  Gene Name: zinc finger protein 114
  Uniprot ID: Q8NC26
  ENST ID: ENST00000597695
  CDS Start-End: 256-1407
acttttttttttttttcgagatggagtctcgctctgtcgcccaggctggagtgcagttgcacgatctcggctcactgcaacctccgcctcccaggctcaggcaatcctccctcctcagcctcccgggtagctgagactacaggcacccgcccacactcacgggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctacgaatgtgaagaatgtgggaaagtcattcgggagtcctcaaaatatacacatataaggagccacactggagagaaaccctataaatgtaagacatgtggaaaagactttgcaaagtcgtcaggacttaaaaaacatcttaagactcacaaagatgagaagccctgtgaatgaaaggaaggtggaaaatttttcattaattttctgactgtaccaaacatgtgaggaggacatattggaagggagctcaaggggttagcatgagtgagaacatcttccctgaactctcgtatcttacagaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacctgccggccgcggtggctcatgcctgtaatcccagcactttgggaggccgaggcgggcggatcacgaggtcaggagatcaagaccatcctggctaacacggtgataccccgtctctactaaaaatacaaaaaaaattagccaggcgtggtggcaggtgcctgtagtcccagctacttgggaggctgaggtaggagaatggtgtaaacctgggaggtggagcttgcagtgagccgagatggagccactgcactccagcctgggggaaagagcgagactccgtctcaaaaaaaaaaaaaagtaggaaagacctctttaaacacttaccactcatgttgcatgtgaatccacatcctgaagggaggc

SEQ ID NO: 201453 - DNA, 9080 bp, Homo sapiens
  Payload ID: 19756
  Gene Name: zinc finger protein 117
  Uniprot ID: Q03924
  ENST ID: ENST00000282869
  CDS Start-End: 1286-2737
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagccctgtctttgttcagggctcagcctttggatgttaatccgctgggccagtggccacctaaataaaaccttcctgttgcacccagtgatctctccggcctcctgattcccacaacatataagcattcctttttctctgcaacctagcccgcatctgtcattgactttttaacaataggcattctgactggatgagatggtatctcactgtggtttttctctgcatttttctaataattaacaacgtgaattttgttttcatatgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaaccgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacccttactaaacataagatgattcatactggagagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatactggagagaaaccctacaagtgtgaagaatgtggcaaagcttttaaccaagtgtcaactcttactatacataaaagaattcatactggagagaaaccttacaaatgtgaggaatgtggcaaaactttcagtcgatgctcaaaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttatagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagactacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttatttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttatatataactttaaaagaggtagaaatatttttagttataattacatttaaagtatacttttttctttgaaaaaattacaaaatttttaaaaagtgaatgatgtaattcaactcaaattacttcatgcttttcattctattgtattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatcattttactaactgtacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggagcaaaacaaatattttaataaagtaatgtactagacaactgaaaacttcaaaaatgctgaaagtaaatgtatactctgctttgtattgaattcattactgccaaatcttctgacttatgattcagaatctctccatgcaaattatgtttttacttgcctgttagtcatgctagacctataattttcttgtttcttaccatttttttcttttatactttatgaggtattatgtgagctgttcatggattataagaatgatttttataaaattcagtactgcacacaagataagttttagatgtatttccaaaattgtgtattaattatatttagttagaacattccatttgttcttttaattggagaatcctatataagcctatatttcttattcttttctcttgttataattgacataagtaaatttatttatttattgagccaatttgttcaggtaagaactaggaatgcttcataagtcatgaggatgtttttatatatatatgtggcaaacaaatatgacagtgcttgctgtgtaacagatgttccataataacctgtaaacattcctgctggagttagtttgtaacttcaagtcagagatggaaaataccaatagtgaagaaataacattgattcttcatgtgcagataacattttttttccatgctgcaaagctaaattttgctgaatttaaaaagaaattttggttcttttatttcctaattacctttagttttgtttgtcttattatgtgacttctgtgtattcatcacagcccttctccttctttttctatgtgatggctacactttgctcactgttgtcttcatgccatgtcattttatacagtactttgtaggttttgatgagaaagttggtatttttaatgcactcaaaaattgctttttattggagagtacttatcaatataactttctgatcagttaattaagataaaaggcatacattgtccacaggtgagaggattaaatcagttagcattatttttttctgtttgtaaaaggaaaaacttattaaatttttaaacggagttattaaacagagtttcactcttattgcccaggctggagtgcaaatatattgtggcaaatataaaatttgctagaaaatacatcttagaaattaagttataagagagcaaatggtaagtgaagaattttaaatttaattttctatgatatagcataacatacatttccatgcagaatcttttatttttaaatgtgaaatttaaaggttgcaaaataataaaatgacttctgtggatttgatatttggaatgatatttcttttttatattgatattacaattccgaggaatttttcactcattatttttttagtgggtgaaggtgagtgtacagttattgctttttgtcacctaactatagtcagcttcttggtcattttctctagaaaacttttgaagattatggcagctttttgattaaacattttctgttatttttatgcaaattcatttattgtgttcacagggtggccagtcatgagaccataagcaacagctgcccttttagtgtctttcatgccattaccatctgtaataaataaatgtgtactttattctgcaaaacatgatgtttggaagtatatgttgtcaaatgcttaattctaggtaattaaggctttacctcacatcgttaacatttttgtggtcagagtatgtgacattgtcaatgtttttcaaaaacacaactacattattatgatctgtagtcactatgctgtacaaaaagatctcttaaacttattcctcctattaaactataattatgtattctttgaccaacatcttccaaaaccccccttttttctaaataccttggtgtctggtggtcaccactttactctctactttaatgggattaagtttcttagaatccctgtgtaagtaaaatcatgaaaaataatctttgtgtctggctcatgtagacaaatatgatgtcctccaggttaattcatgtgattgaaaataatagaaatttcttttttaaagacgaagagtattccattgtgtatatgtaccacattgtctttatttactcataaatgttgaactgttgattgtgtattttggtaattgtgaagagtgttgcaaacaacatagaagcataaatgtttcttcattctgatttcacttgttttggatatatacagtaaaattgctgtattgtggtttaattttaaattttttgacaaatttttgtttttcatagtgactctcctcattcacattcaaaccaacagtgtgcaagcattccttttcttcatactttgactaacactttcttttctttttagtaagagtaattctaacaggagtgagttgataatctcctggtttttctttttgctttcctgattatagttgatattgagcattttttatatatcttgaccatttgtcttttcttgaaaaatatttaagccttttgctcatttttaatagttatttgtcttctgttgtatagtcatttaagttgtttatatgtttctgttattaaccctttgtcccacgtatgatttgcaaatattttctcccatttttttcagttgtctcattttgttgattgtatcagattccatgaagcagctttttaatttcaagtaatctaacgtatctatttttcttttgatttccttggattttgaggttaaataataaaagtcacagcctaga

SEQ ID NO: 201454 - DNA, 5317 bp, Homo sapiens
  Payload ID: 19756
  Gene Name: zinc finger protein 117
  Uniprot ID: Q03924
  ENST ID: ENST00000620222
  CDS Start-End: 199-1650
cagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaaccgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacccttactaaacataagatgattcatactggagagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatactggagagaaaccctacaagtgtgaagaatgtggcaaagcttttaaccaagtgtcaactcttactatacataaaagaattcatactggagagaaaccttacaaatgtgaggaatgtggcaaaactttcagtcgatgctcaaaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttatagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagactacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttatttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttatatataactttaaaagaggtagaaatatttttagttataattacatttaaagtatacttttttctttgaaaaaattacaaaatttttaaaaagtgaatgatgtaattcaactcaaattacttcatgcttttcattctattgtattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatcattttactaactgtacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggagcaaaacaaatattttaataaagtaatgtactagacaactgaaaacttc

SEQ ID NO: 201455 - DNA, 1374 bp, Homo sapiens
  Payload ID: 19756
  Gene Name: zinc finger protein 117
  ENST ID: ENST00000610793
  CDS Start-End: 101-1252
gtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgac

SEQ ID NO: 201456 - DNA, 2921 bp, Homo sapiens
  Payload ID: 19757
  Gene Name: zinc finger protein 12
  Uniprot ID: P17014
  ENST ID: ENST00000342651
  CDS Start-End: 543-2522
ccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaa

SEQ ID NO: 201457 - DNA, 662 bp, Homo sapiens
  Payload ID: 19757
  Gene Name: zinc finger protein 12
  ENST ID: ENST00000394917
  CDS Start-End: 463-662
agagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctggtatcacattatcaaaccggatgttatcagcaagttggagcaaggagaagagccatggata

SEQ ID NO: 201458 - DNA, 4474 bp, Homo sapiens
  Payload ID: 19757
  Gene Name: zinc finger protein 12
  Uniprot ID: P17014
  ENST ID: ENST00000404360
  CDS Start-End: 188-2059
ggaagggaaaggtggcatttgccagccctggaataattcgggttagtggcagaggcttgtaaaggcactcaggagaccagcattaggggcctgagggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaa

SEQ ID NO: 201459 - DNA, 5051 bp, Homo sapiens
  Payload ID: 19757
  Gene Name: zinc finger protein 12
  Uniprot ID: P17014
  ENST ID: ENST00000405858
  CDS Start-End: 543-2636
ccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaa

SEQ ID NO: 201460 - DNA, 1563 bp, Homo sapiens
  Payload ID: 19758
  Gene Name: zinc finger protein 121
  Uniprot ID: P58317
  ENST ID: ENST00000320451
  CDS Start-End: 233-1405
atcttttccggcgctggctccgcatggtcagtgccatttcgcctttatcgtggtggagtccaccctggctgtggacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaatgtgggaaagcctacaatagattttatttacttactaaacatttaaaaacacactgaagaaaaactctgaatgtaaggaatgtggaaatcttttaggaatttctcataccataattaccacatttgaattcacactgaagagaaattttattggtacaaagaatgtgaggaggccttcagttatccccattcacttcgaagacatgaaagaactc

SEQ ID NO: 201461 - DNA, 546 bp, Homo sapiens
  Payload ID: 19758
  Gene Name: zinc finger protein 121
  ENST ID: ENST00000591447
  CDS Start-End: 94-546
atgagactgatgatctgtcactgtctcccatcacctagatgggactgtctagttgcaggaaaacaagctcaggcctcctgctgatcctattttatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaa

SEQ ID NO: 201462 - DNA, 7177 bp, Homo sapiens
  Payload ID: 19758
  Gene Name: zinc finger protein 121
  Uniprot ID: P58317
  ENST ID: ENST00000586602
  CDS Start-End: 418-1590
tttcgcctttatcgtggtggagtccaccctggctgtggggctgtcggtcctccttgcgcggccagtggctagaggccgcaggctcagtgggtcccagtcaggagccaggtcgggaagtgtgtttgtcccgactccgcgcgttttctggagtggtttcatccgctgtgctcccttcttcaaaagcttggaaagcaacctttgacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatgatgggactgtctagttgcaggaaaacaagctcaggcctcctgctgatcctattttatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaatgtgggaaagcctacaatagattttatttacttactaaacatttaaaaacacactgaagaaaaactctgaatgtaaggaatgtggaaatcttttaggaatttctcataccataattaccacatttgaattcacactgaagagaaattttattggtacaaagaatgtgaggaggccttcagttatccccattcacttcgaagacatgaaagaactcatactctatgtgtcccctataaattttaggaatgttagggagccaatggaatctttttttattattttattttattttattttattttattttattttattttattttatttgagacagagttttgctgttgtcatcacacaggctggagtgcaatggcatgatcccagctcactgcaacctttgtctcctgggttcaggcgattctgcctcagccttcaagtagcttggattacaggtgccgtcaaccacacccagctaatttttgtatttttagtagagatggggtttcaccatgttggccaggctggtctcgagctcctgacctcaggtgatccacccgccttggcctcccaaagtgctgggattataggagtgagccactgctcctggccttttttttttttttttttttttttttttttttttgtaagtcgttgttaatacacattcttttctcaagggattggattgtggtcacaatccaacatttgagaactcaccatggggccatacaatgtagaaaacacagaaagccctcattatttccttaggcctttctaagtatataagatgttgcaatggagaagagaaaccctattgatacaagatacaggcatgccctgtagatattgtgagttttgttccagactaccactataaagtgaatatcacaataacatgaatcatacaaatgttttggtttcccagtgcatataagttaggtttacatcatatggtagtctcttgtgtgcagttgtgttatgtctaagtaaagtaccttagtttaaaatactttattgccaaaaagtgctaatgatcatgtgagactttggtgagttgtaatctttttgcttgtggtaggtcttgcctcagtgttgatggctgttgatcagggtggctgtggcagtttcttaaaataagacagcagtgaagattgctgcattgattgactcttcattacatgaaaaacttctctttagcattcgacgctgtttgataacattttacgcatagtggaacttcttttagaattggacttaatcctctcaaacttcgccactgcttgatcaactaagttgatgtaatattctaagtctgttgtcttttcaacaatgttcacagcatcttcaggagtagatttcatttcaggaaaccactttctttgcttatctatacaaagcagcctctcatctgttcaagttttttcacgagattgaaacaattctgtcacatcttcaggctccacttctaattctagttctcttttttccatcacatccacagttactttttccactgaagacttgaacccctcagagtcacctatgaaggttggaatcaacttcttccaaactctggttaatgttggtttttatttttttaattaaaaaaattttttttagagacaaggtctcgctgtgttgttcatgctggagtacaagtgggtattcaccagcacgatgagagcacactgtagccttgaactcctggcctcaagtgatcctccttcctatgcctcctgagtagccaagactccaggcacacaccaccacacctgccttaatgttgatattttgacctccttccatgaatcataaatgttgttaatggcatctagaatggagaatcctttctgcaaggtctgcaacttaatttatccagatccctcagaagaagcattattagtggcagctatagccttatgaaatgtatttcttaaataataagacttgaaagtcagaattattccagaatccatgggctgcggttagcagacatgaaaacgccaatcttgtttatacctccataagagctcttggttagtaggttcattatcagtggtaatattttgaaaggaatctctgaacagtatgttttacagtgggcttaaaatattcagtaaaccatgctgtaaatagatgtaaatagataccacaggaagagtagatgtagcataattcttaactggctcttggatttttggaatggtaattgaatattagcattcatttaaagtcaccaactgcattgacctctaacaagaaagccagcccaggctgggaaaagtggcttacacctgtaattccagtgctttgggaggctgaggttggaggatcacttgaggtcaagagttcaagaccagccagcacaacagagcgtgacgctgtctctacaaagtaaagagtcagcccgtcctttgaatctttgaagtcagatattagcttacctagagctgtgaaagtcctaaatggcatctcctgaagtaaggctgttttgtctctgttaaaactctagtagagctacctctgccatttatctagatattctggaaatgcttgctgcagattccacatcagcaattgctacttcactttgtacttttatgttatggaaatgacttgttaaacctcacgaactgatctttgccagcttccagcatttcttctgcagctaactcacctctcagccttcatagaattagagttagggccttgctctggattaggttttggcttaagggaatgttgtggctggtctgatcttctatccagaccactaaaacttattccgtgttagtggtgaggctgttttcctttcttattatgtgtgtgttcactggagtagcacttttagtttccttcaagaactttacattcacaacttggctaactggcacaagaggcctagattttggcctatcccagttttttttttttttttttttttgagacatggtctcccttttgcccaggctggagtgtagtacagttatagcccattgcagcctcaaacttacgggttccagtgatcttcctgtctcctgagtagctaaagactgcaggtgtgcaccaccatggccagctaatttttttttttttttttttttttttttaaagaggcaggactttactgtttacccggctgatcttgaacttaaaacctcaagtgatgctcccctatctgcctcccaacactctgggattacaggtgtgagccactgcacctggctcttatcttggcttttgacatgactttctcactgaggttaatcatttccagcttttgatctaaagtgagaaatttgcaactccttctttcacttgaacagttagaggccattgtggggtaatgaattggcctaatttcaatattgtccctcagggaattaggaggcctgggaagaggaggagagaggggagagtggccagttggtggagcagtgagaacatagcatttgttaagtttgctgtcttcgaaggttgtggtttgtggtaccccaaaacaattaaaataggaacatcaaagatcacagagcagccgggcacggtggctcacacctgtaatcccagcaccttgagaggctgaggtgagtgaatcatgaggtcaggagttcgagaccagcctggccaccatggtgaaaccccgtctctactaaaaatacaaaaaattagccgggcatggtggcaggcacctatagtcccagctattcaggaggctgaggcaggagaatcacttgaatccaggaggtggaggttagagtgagctgagatcacaccactgcactccagcccaggtgacagagtgagattccttctcaaaaaaaaaaaaaaaaaaaaatcacacagcaccacagtaagtataataataaggaaaatgtttgaaatattgtcagaattgtcaggatgtgagagacaaagtaagcacatgctgttggaaaaaatggtgttatagatttattcgacatgacattgccacaggacttctacttgtgaaaaatatctgtaaagtgagatgaagcaaagtgaagtaacatgaggtatgtctgtagctgttgctgtagtggtttccaaatggtggttttcttttccttttttttttttttctttttggtctgcattggggtcttgctctgttgcctagggtgtggagtgcggtggcatgatcatgcctcactatagccttgacctcctgggctcaagcgatcctcccacctgagtctcctgagtacctgggaccacaggcacatgctaacgcacccacttaatttttttattcgtagagccgaggtctcactatgttgcccagactggtctcaagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatc

SEQ ID NO: 201463 - DNA, 1674 bp, Homo sapiens
  Payload ID: 19759
  Gene Name: zinc finger protein 124
  Uniprot ID: Q15973
  ENST ID: ENST00000340684
  CDS Start-End: 140-1009
ggcctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttg

SEQ ID NO: 201464 - DNA, 1292 bp, Homo sapiens
  Payload ID: 19759
  Gene Name: zinc finger protein 124
  Uniprot ID: Q15973
  ENST ID: ENST00000543802
  CDS Start-End: 91-1146
cgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaaggcacatcatatctcattctggaaacaacccatatgggtgtgaggaatgcggaaagaagccatgtacatgtaaacaatgtcagaaaacttccctttctgtcacaagggttcacagagacacagtaatgcacactggaaatggacattatggttgtacaatatgtgagaaagtttttaatattcccagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatga

SEQ ID NO: 201465 - DNA, 2243 bp, Homo sapiens
  Payload ID: 19759
  Gene Name: zinc finger protein 124
  Uniprot ID: Q15973
  ENST ID: ENST00000472531
  CDS Start-End: 129-350
ctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacggctcacgtaggccgggcgcagtggctcacgcctgtaatcccagcactttgggaggccgaggcgggcagatcacaaggtcaggagatcgagaccatcctggctaacacggtgaaaccccatctctactaaaaatacaaaaagtagccgggcgtggtggtggatgcctgcggtcccagctactcaggaggctgaggcaggagaatggcatgaacccgggaggcggagattgcagtgagccgagatcgcgccactgtactccagcctgcgtgacagagcgagactccgtctcagaaaaaaaaaaaaagaacataatatgtgtattgtgtctcatgtacactgttgaagaggtagcagcccatgattgatgaaatagtccagtgatcttatgagatacaagtttgttttcatgttctctctctgacattgtctatgcttagttattgtgttcatgcttattccttcatggtccaagttggctgtcccacctccaggcatcaaaccacattccaaacagcaaccaggaggaaatagtaagctgataggtcatggggaattaggttggaagccattgctttttaatttacagaagtccattctccccaggcacttctttctaagtctcattgatcagaactcaaccacgtggccaccatcagcagaaacatctctctgtagcaccgtgaaacacatgagaacataactggggatgaccgttgttacttgaactattttgaaagatctgacataaaggtcatcgccttgtgcacttcaatgggtgttactgcaaaactcccagggctaggcatggcgacatacacccgaaatctcagctatctgggaggctgaggtgggaggattgcttgagcccacgagtttgaggctgaagtgtgcctgtgaatagctactgcactccagtgcctaggacacatagggagacctcacttttttatggctgcatagtattccatggtaaagaaatgtaccacattttctttatccacttcactgttgatgggcatttatccacttcactgttggtgggaatttaggttgaatccatgtctttgctattgaagtcacactttttaatcaagttatttaactttcctgtgttcatttgtgttatataccagaacatttttatttctatggttttaatgccacctaatatgattatcaatgtgtcattctccataaatcattgtgttatacatgttaaacgattaggtattaagtgtataggtataaatcacttagaataatgactaacacattgtatgaactaaataagtactgattcatctgattcatcaaatttccattattcataccattcattatttattaagtggtgtagtatttgttcttatcaacatttgcttttctgtcctatctaaatattaatgaaacagtggatgtgggctcagtgtgctgtcttgaaataatccaaagtcaaatggcatgcttcactggtttcctttagatgcaataactcatttgactcacacaataaaaatgagtattaagta

SEQ ID NO: 201466 - DNA, 956 bp, Homo sapiens
  Payload ID: 19759
  Gene Name: zinc finger protein 124
  ENST ID: ENST00000491356
  CDS Start-End: 126-359
gtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgtactggttcatgaagatgtgcttatgggtttctactctagtaagttttgggtctatgtatgtacctttctttctctgcactcttggggcaaggaattgccatgtgattgatcggagaattgttcattttaaattagtccagaatttttatgttttatttcttctaaaacaaacgaaaacgggatacgtgtagaacatgtgagtttgttacatgggtatacatgtgccgcggtggtttgctgcacctattgacctgtcctctaagttccctcccctcaccccccaacccccaacagcccctggtgtgtgttgttccccctctgtttccatgtgttctcaatgttcagctctcacttatgagtgagaacgtgcagtgtttagttttctgttcctgtgtttgctgaggatgatgacttccagcttcatccatgtccctgcaaagcacatgatctcattcctttttatgtctacatagtgttctatggtatatatatacacatatatatatacaccacattttctttatccagtctatcattgatgggcatttgggttggttccatgtctttgctgttgtaaataatgttgcaataaacatacgtgtgcacgtg

SEQ ID NO: 201467 - DNA, 2400 bp, Homo sapiens
  Payload ID: 19760
  Gene Name: zinc finger protein 131
  Uniprot ID: P52739
  ENST ID: ENST00000306938
  CDS Start-End: 45-1814
gcaagcctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgtt

SEQ ID NO: 201468 - DNA, 3340 bp, Homo sapiens
  Payload ID: 19760
  Gene Name: zinc finger protein 131
  Uniprot ID: P52739
  ENST ID: ENST00000509634
  CDS Start-End: 457-2226
gaagagggagggcgggggagggagaggcgacccgagagtcgttgtgggtcgcgggccggaccgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattaggtcaggctcggagtcccgcggccgcggctccggtctcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccata

SEQ ID NO: 201469 - DNA, 1050 bp, Homo sapiens
  Payload ID: 19760
  Gene Name: zinc finger protein 131
  ENST ID: ENST00000515326
  CDS Start-End: 257-1050
gaacgtgctcgcgcccgtagctgccgctgccggggccgcggccgcccgggtgcccaaccgaacgcacgtgcgccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcg

SEQ ID NO: 201470 - DNA, 501 bp, Homo sapiens
  Payload ID: 19760
  Gene Name: zinc finger protein 131
  ENST ID: ENST00000508259
  CDS Start-End: 47-501
gtgacgcgcaagcctgggccgctcctccttccctcacccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaa

SEQ ID NO: 201471 - DNA, 760 bp, Homo sapiens
  Payload ID: 19760
  Gene Name: zinc finger protein 131
  ENST ID: ENST00000502623
  CDS Start-End: 1-205
taagaagcaaagaactgggaaaaaaattcatgtatgtcagtactgtgagaaacagtttgaccattttggacattttaaagaacatcttcgaaaacatacagttctggatgctaagaagttcactgttatgaggccacatctggtgagagccctgccagtggcgactctgcagagtcctgaggccatgcagggcatcacatggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataa

SEQ ID NO: 201472 - DNA, 3209 bp, Homo sapiens
  Payload ID: 19760
  Gene Name: zinc finger protein 131
  Uniprot ID: P52739
  ENST ID: ENST00000505606
  CDS Start-End: 249-2018
gagaagagggagggcgggggagggagaggcgacccgagagtcgttgtgggtcgcgggccggaccgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatgtg

SEQ ID NO: 201473 - DNA, 572 bp, Homo sapiens
  Payload ID: 19760
  Gene Name: zinc finger protein 131
  ENST ID: ENST00000509341
  CDS Start-End: 156-572
ggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaa

SEQ ID NO: 201474 - DNA, 1352 bp, Homo sapiens
  Payload ID: 19760
  Gene Name: zinc finger protein 131
  ENST ID: ENST00000507218
  CDS Start-End: 44-295
acgcgcaagcctgggccgctcctccttccctcacccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttca

SEQ ID NO: 201475 - DNA, 2599 bp, Homo sapiens
  Payload ID: 19760
  Gene Name: zinc finger protein 131
  ENST ID: ENST00000510026
  CDS Start-End: 222-983
ccgcggccgcccgggtgcccaaccgaacgcacgtgcgccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaa

SEQ ID NO: 201476 - DNA, 970 bp, Homo sapiens
  Payload ID: 19760
  Gene Name: zinc finger protein 131
  ENST ID: ENST00000509931
  CDS Start-End: 16-216
agcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaaccc

SEQ ID NO: 201477 - DNA, 2063 bp, Homo sapiens
  Payload ID: 19760
  Gene Name: zinc finger protein 131
  Uniprot ID: P52739
  ENST ID: ENST00000509156
  CDS Start-End: 37-1908
gcggtgacggtgtgcgtcgacagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattc

SEQ ID NO: 201478 - DNA, 956 bp, Homo sapiens
  Payload ID: 19760
  Gene Name: zinc finger protein 131
  ENST ID: ENST00000511736
  CDS Start-End: 16-390
agcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttgacagggtctcgctgtgtcacccaggctagagtgcagtggcacaatctcggcttactgcaacctttaacttctgggctcaagcaaccctcccacttcagcctcctgagtagctacgactacagaacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatcacccccctccccgagcgactgcactgggtgtc

SEQ ID NO: 201479 - DNA, 583 bp, Homo sapiens
  Payload ID: 19760
  Gene Name: zinc finger protein 131
  ENST ID: ENST00000507393
  CDS Start-End: 346-583
atcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagctgccatgtcctgtggagagcctggcatgaacagaggccttgcggagaactgaagccttcagtccaagagccagggaggaactgaattctgtcaagaaccacttgagtgaccttggaagcagatcctttcccattggagccttgagattaaagccaccttacctgacaacttgataggagccttatggggtctcgctatgtgcccaggctggcctcaaactcctgggctgaactcctcctccccaactcggcctcccaaagtgctgggattacaagcgtgagccaccgcgcccgcccacatctcttcttacagagcagcccgacggccatggaggctgaagagacgatggaatgccttcaggagttccctgaacatcataaaatgatcctcgaccgattgaatgaacagcgagagcaggacc

SEQ ID NO: 201480 - DNA, 3031 bp, Homo sapiens
  Payload ID: 19761
  Gene Name: zinc finger protein 132
  Uniprot ID: P52740
  ENST ID: ENST00000254166
  CDS Start-End: 402-2522
gagccaatgaaagctcggaccagtggcaagtccgagctgtcattgagaggcgggacttccggcgccgccattgcggtcctcattttgctgctggtgggttgggctacagcaggcctctggagccacaccagggcacgggagtgggtgcagggaccgtcaccgcgccttcacacgcaccatagtgcccggctaattactctgcttttatgagccaaggtgttcccgaaagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttatggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtca

SEQ ID NO: 201481 - DNA, 2242 bp, Homo sapiens
  Payload ID: 19762
  Gene Name: zinc finger protein 133
  Uniprot ID: P52736
  ENST ID: ENST00000316358
  CDS Start-End: 98-2062
atctaccttctgagatatcatccttcttcagggagataaggaaaaaaagccacagggtcccggagagccaggggaatgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 201482 - DNA, 481 bp, Homo sapiens
  Payload ID: 19762
  Gene Name: zinc finger protein 133
  ENST ID: ENST00000360010
  CDS Start-End: 185-481
ggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagatcatcaagaatatggaaacaactgtgacctacagaaagaagcagatccagagccagagctctacctcgatcctttctgc

SEQ ID NO: 201483 - DNA, 2701 bp, Homo sapiens
  Payload ID: 19762
  Gene Name: zinc finger protein 133
  Uniprot ID: P52736
  ENST ID: ENST00000377671
  CDS Start-End: 560-2521
cgccgagcatcctgggaggtgtggtccgggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatgcttcaaaagttctgctgcctgagagtaacgtcacagtaatggaacgggaagattctggaatctgtgtccccacctagacaacgattatactggcaggatctatcaggtgtacctattttggaactctggagtctagttgaaggcctccagttcccagggggaaggaagcatggaggtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 201484 - DNA, 2642 bp, Homo sapiens
  Payload ID: 19762
  Gene Name: zinc finger protein 133
  Uniprot ID: P52736
  ENST ID: ENST00000401790
  CDS Start-End: 500-2464
gctcagaaggagggtcacagtagggccaggcactcttctcgggagctcctacgtgttttatgcacgtggttaagaaaaaagagggagaattcaggtgccacagtggccattctccggtgaccggagcgtgttactcagaaacggatccgtcagaggccaatgggagctgccggccttcagggcgcgcctggtggcgccgagcatcctgggaggtgtggtccgggcgctgtgccgaggattcggggtagtgtagtcctggcgccccgctggaggagctccccagctggtggctggagcgaccccttgttctttggtggcgctgtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201485 - DNA, 2622 bp, Homo sapiens
  Payload ID: 19762
  Gene Name: zinc finger protein 133
  Uniprot ID: P52736
  ENST ID: ENST00000402618
  CDS Start-End: 669-2444
gctcagaaggagggtcacagtagggccaggcactcttctcgggagctcctacgtgttttatgcacgtggttaagaaaaaagagggagaattcaggtgccacagtggccattctccggtgaccggagcgtgttactcagaaacggatccgtcagaggccaatgggagctgccggccttcagggcgcgcctggtggcgccgagcatcctgggaggtgtggtccgggcgctgtgccgaggattcggggtagtgtagtcctggcgccccgctggaggagctccccagctggtggctggagcgaccccttgttctttggtggcgctgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagaaaaacagcagctcttacaatgatgttgagcacattaaaaagaatgctgtacaatccaaggagcaagtcattgtggttgcccaggaagctgtcttggaaacccaaaatatatgtgtaacgggaggaagactgttctagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201486 - DNA, 2717 bp, Homo sapiens
  Payload ID: 19762
  Gene Name: zinc finger protein 133
  Uniprot ID: P52736
  ENST ID: ENST00000396026
  CDS Start-End: 578-2539
gctcagaaggagggtcacagtagggccaggcactcttctcgggagctcctacgtgttttatgcacgtggttaagaaaaaagagggagaattcaggtgccacagtggccattctccggtgaccggagcgtgttactcagaaacggatccgtcagaggccaatgggagctgccggccttcagggcgcgcctggtggcgccgagcatcctgggaggtgtggtccgggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatgtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201487 - DNA, 523 bp, Homo sapiens
  Payload ID: 19762
  Gene Name: zinc finger protein 133
  ENST ID: ENST00000434018
  CDS Start-End: 96-523
agtgtagtcctggcgccccgctggaggagctccccagctggtggctggagcgaccccttgttctttggtggcgctgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagc

SEQ ID NO: 201488 - DNA, 637 bp, Homo sapiens
  Payload ID: 19762
  Gene Name: zinc finger protein 133
  ENST ID: ENST00000425686
  CDS Start-End: 101-637
gatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaac

SEQ ID NO: 201489 - DNA, 2341 bp, Homo sapiens
  Payload ID: 19762
  Gene Name: zinc finger protein 133
  ENST ID: ENST00000535822
  CDS Start-End: 160-2163
gctcagaaggagggtcacagtagggccaggcactcttctcgggagctcctacgtgttttatgcacgtggttaagaaaaaagagggagaattcaggtgccacagtggccattctccggtgaccggagcgtgttactcagaaacggatccgtcagaggccaatgggagctgccggccttcagggcgcgcctggtggcgccgagcatcctgggaggtgtggtccgggcgctgtgccgaggattcggggtagtgtagtcctggcgccccgctggaggagctccccagctggtggctggagcgaccccttgttctttggtggcgctggaatttcattttctaaaccagaactcatcacccagctggagcaagggaaagagacctggagagaggaaaaaaaatgttcaccggcaacctgtccagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201490 - DNA, 2245 bp, Homo sapiens
  Payload ID: 19762
  Gene Name: zinc finger protein 133
  ENST ID: ENST00000538547
  CDS Start-End: 160-2067
gctcagaaggagggtcacagtagggccaggcactcttctcgggagctcctacgtgttttatgcacgtggttaagaaaaaagagggagaattcaggtgccacagtggccattctccggtgaccggagcgtgttactcagaaacggatccgtcagaggccaatgggagctgccggccttcagggcgcgcctggtggcgccgagcatcctgggaggtgtggtccgggcgctgtgccgaggattcggggtagtgtagtcctggcgccccgctggaggagctccccagctggtggctggagcgaccccttgttctttggtggcgctgatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201491 - DNA, 2660 bp, Homo sapiens
  Payload ID: 19762
  Gene Name: zinc finger protein 133
  Uniprot ID: P52736
  ENST ID: ENST00000622607
  CDS Start-End: 518-2482
gctcagaaggagggtcacagtagggccaggcactcttctcgggagctcctacgtgttttatgcacgtggttaagaaaaaagagggagaattcaggtgccacagtggccattctccggtgaccggagcgtgttactcagaaacggatccgtcagaggccaatgggagctgccggccttcagggcgcgcctggtggcgccgagcatcctgggaggtgtggtccgggcgctgtgccgaggattcggggtagtgtagtcctggcgccccgctggaggagctccccagctggtggctggagcgaccccttgttctttggtggcgctggttcattcctgatgctgttaaggaataggaggtactgccctgctggagaggatttcccttgattttcttgaacgctttttgttcttgttctgcctccctgtggctcctgtctgcccagagaggactgcctgctggggaaagggggtactcctgagctcctgacagcccagcttcagttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201492 - DNA, 1999 bp, Homo sapiens
  Payload ID: 19762
  Gene Name: zinc finger protein 133
  Uniprot ID: P52736
  ENST ID: ENST00000630056
  CDS Start-End: 142-1821
agtgtagtcctggcgccccgctggaggagctccccagctggtggctggagcgaccccttgttctttggtggcgctgatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 201493 - DNA, 616 bp, Homo sapiens
  Payload ID: 19762
  Gene Name: zinc finger protein 133
  ENST ID: ENST00000626025
  CDS Start-End: 65-208
ccccagctggtggctggagcgaccccttgttctttggtggcgctgttttgtgttacaggcacacatggcattcagggatgtggctgtggatttcacccaggatgagtggaggctgctgagccctgctcaaaggactctgtacagagaggtgatgctggagaactacagcaacctggtctcactggttacttattttcttttcctgtgagcaggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtc

SEQ ID NO: 201494 - DNA, 2318 bp, Homo sapiens
  Payload ID: 19762
  Gene Name: zinc finger protein 133
  Uniprot ID: P52736
  ENST ID: ENST00000628216
  CDS Start-End: 170-2143
gtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatc

SEQ ID NO: 201495 - DNA, 4914 bp, Homo sapiens
  Payload ID: 19763
  Gene Name: zinc finger protein 134
  Uniprot ID: P52741
  ENST ID: ENST00000396161
  CDS Start-End: 311-1594
atcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacatttaatcttggggcttcttcttatggtctggggtggattgaaaacaggctctgccaaactgaagacagcctttgtgcggtgcctccaactttgcctcaaatgggacagtgggttgagggagaacagttcttagtccagttttgatgttaacttccatagctgacaaagcttgttaagtaagaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacactgttgagggaaagctgttcctcaggacctgctgagtggccatattccctgaaggcctgaatctgtttcacaggccactgttggtaagatctaaagcatccagtagggaaacaaaattgataaatattgagtgtgagtaattgggattggggagattgtggcaaactagaggggaagtgcccattgtaaaaacacatccacagacagtccaggcactaaggctgaatgggatcagggtatccagaaatctcaggatctccagggccatgttactgttaggtcaaggtcactggtgcagcaacgaatgtagtttttctagattcctctccctccctgggctctttacctaatgtctttgcggcacaggcggtaaccctgggagtaaagaggtgtggtccaaggaagtagcttttgtgaccagctggagtttctggtgactcttttggcaatggtcctcattgtttgccagtttttcttactactgaggaagagattgtcttcccaagatatttggagtgataagagtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgcaaatattgatgcatgagtctttatgtggacacttagctgagaacatttttaagcagaggttttgaaggtgtgaccatatatcttactaattatagtaaaatatattggaaaagagatacatacagggaagaactgtgaaacagaaaagacctaagatttgatgatttgggaaattctcagcccatcttaattggaaaaaaaaaacaaaccattgaaattaagagattcattgttaggaaagatagatgttttagagagagagatgttttagagagatagccaaggatgtttgctgataccgggatcaaaacatacatcagaacactgtcacacaaaaagctctttgaagagattaaatgtgacttgtagatcccctcaatacaaacaatttataagaagtttaaactatcactcatctcagcaaaagccaaaaatatagataggggattccctaggaggaataatctgcataaacctcttttctaatgttgtgaatttcagtgatgtacaggagactcacaaaattcttgaaaattttataccagtggaaatgctcaccttgggtctaaagggaccttgaaagtatgaagttaaagggtgtaggcatgtaaagtgtgaagttaaaggttgtaatattctatacatgggactggctgcggaaacaggtgcaagcccttgctacctttcatgagaaaggaaggatgactcagagcagaggagagtccagtgggcagagtcctgaaccatgtgatattcccatgtcttgactcccagtggcatttgccaaactagatttcagattttcttgggattggtggttccattttttttgttttccccccttccatttcctccccttttgaaacaatgcatatacatataactattatcctaggtctttcccaaccttttgtttgggagcagataactagttttctagttttacagatccaaatgagacaggaatagcactgggtggtcacaggaggatggaaaatctcaacaccctggttttggtgcagctgaaaaaaaaaaagaaaaacccaaacaacagctaaaacgggaactaggcaaagaaaccgtgggataacagaaaacccaaaacaaaagagaaaactgccagaaccccagtcagggtgacatgtctgtaactcttccaggcaaacccaaataagggaggaggggtggtaatcaggggtccctgaaatcccctcttttcccagaatacctaatgattacccctattaaaggaacacccatacaattagaaacccaaactttgttttgcatgacttgctctcaggggcactcccacacttctctcttgtgtgtacttttgcttcacaataaaagctgcttgcctttgcttc

SEQ ID NO: 201496 - DNA, 590 bp, Homo sapiens
  Payload ID: 19763
  Gene Name: zinc finger protein 134
  ENST ID: ENST00000600883
  CDS Start-End: 392-590
gtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggaggaatgggagctgctggatgaggctcagagactcttctattatgaaataatggcttctgtgcttcgcatttatagtctccctggatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatg

SEQ ID NO: 201497 - DNA, 483 bp, Homo sapiens
  Payload ID: 19763
  Gene Name: zinc finger protein 134
  ENST ID: ENST00000600344
  CDS Start-End: 324-464
cctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggtgagtgggagctgagggacgccataacctcagggctgggttcctgtagttccggaaacctatgttgtgcccatcacaagtgccaaggccagaggccctaacttatttctacctttttat

SEQ ID NO: 201498 - DNA, 2091 bp, Homo sapiens
  Payload ID: 19763
  Gene Name: zinc finger protein 134
  Uniprot ID: P52741
  ENST ID: ENST00000622676
  CDS Start-End: 523-1569
catcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccaca

SEQ ID NO: 201499 - DNA, 3025 bp, Homo sapiens
  Payload ID: 19764
  Gene Name: zinc finger protein 135
  Uniprot ID: P52742
  ENST ID: ENST00000313434
  CDS Start-End: 102-2078
ggagttaggctcgcgccggcgcagtgtcggctgccggtgccgcggcctttgtctcgcagtcaggaggagcagggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaa

SEQ ID NO: 201500 - DNA, 2120 bp, Homo sapiens
  Payload ID: 19764
  Gene Name: zinc finger protein 135
  Uniprot ID: P52742
  ENST ID: ENST00000359978
  CDS Start-End: 4-1176
gaaatggagttaggctcgcgccggcgcagtgtcggctgccggtgccgcggcctttgtctcgcagtcaggagggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttag

SEQ ID NO: 201501 - DNA, 2253 bp, Homo sapiens
  Payload ID: 19764
  Gene Name: zinc finger protein 135
  Uniprot ID: P52742
  ENST ID: ENST00000511556
  CDS Start-End: 72-2084
gtcggctgccggtgccgcggcctttgtctcgcagtcaggaggggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagagattaagggacatttccagtttttgcttctttcagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccat

SEQ ID NO: 201502 - DNA, 3349 bp, Homo sapiens
  Payload ID: 19764
  Gene Name: zinc finger protein 135
  ENST ID: ENST00000506786
  CDS Start-End: 555-2405
gtgccgcggcctttgtctcgcagtcaggaggagcagggccagccgttcctgccagaagccagggcatgacccctggggtgcgcgtctccacagacccggtgagaatctcggcctccttgcgcgtgtcctccacctcgtgcccggcctcctcgcgcgcggccttctcacgcccggcctcctctttgcaccccgtccctactcgcgctcagcctcctccttgtgcccggcccctacttgcgtgcccggcccctactcgtgcccggcctctactcgcacaactggcctctactcgcgcacctggcctctactggtgcccggcctctactcgtgcccggcctctatttgcacatctagcctctactcgtgtccggcctctacctgcacacccggcctcctaaagtccgcgccaagctccccaaccacagcctgcctctgaaaggaccgcccacgccgcgctggaggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttag

SEQ ID NO: 201503 - DNA, 3346 bp, Homo sapiens
  Payload ID: 19764
  Gene Name: zinc finger protein 135
  Uniprot ID: P52742
  ENST ID: ENST00000401053
  CDS Start-End: 4-2052
gaaatggagttaggctcgcgccggcgcagtgtcggctgccggtgccgcggcctttgtctcgcagtcaggagggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagagattaagggacatttccagtttttgcttctttcagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaacttctgttttgcaagattcatcttttttgggatatgttcaagttaatcctctcaaactgctttttcattgttttcatacaatttaacattttgttaaaccctaagtccacaaatagcagtctttctgacaactataacctttaaatggtgacttgctgccctcattagaaattgcattggctggccaggcgcggtgacttatgcctgtaatcccagcactttgggaggccaaggtgggaggatcacctgaggtcgggagatggaggttgcagtgagctgagatcgtaccattgcactccagcctgggcaacaagagtgaaactctgtctcagaaaaaaaaaaaaaaa

SEQ ID NO: 201504 - DNA, 2836 bp, Homo sapiens
  Payload ID: 19764
  Gene Name: zinc finger protein 135
  ENST ID: ENST00000515535
  CDS Start-End: 270-491
agcagatatgtgtccgcacccgccaggccttcagcttccctcagacaggcgggaaaaccctaggctgcccttctccgagcggagggccgccccacacacagcaggcgcttaaacgggtacgcggggccctggacggctctccgcggagctccccaggctctggcgcagttccccggcttggggacctgagcaccgcctctgcctgccccagctgctcacctcccctttcccacagagcagggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtggggtcttgctctgtcacccaggctggagtgcagtggctcaatctcagctcactgcaaccttgacctcccagtttcaagccatcctcccacctcagcctcccaagtagctgggactacgggtgtgcaccaccgtgcccagcttcagcctcacaagtgctgagattacaggtgtaagcctctgcatctggcccagttagccatacagtggaaaaactgcactctaaccaggtgagcaaagagaacatcactgacaggaggaatgtggacaccgtgcaccctggatgggatgggggaaggcgcacacatgcaggccacagattagaagtgaagttgacatcacgccaagtacgaaaaggctaaacagctgacaaaatttccacttgagcaaccctggggagcgcaaacaggaggaatcggggcaagggtgacttgaagaaagcactggcagatcacgcactttaaggcaactctacactgcacaatgtcaaataacctagcatggggcggcactaaatggctgcaggaaagccgagtcttcttccacatccggcggctcccctcggatgcgagcgctggcccagggtgtgtttacagaggtgagggcttcccgtggacccttctcgttgggagcgcttagcctcaggagcggattcagggcacaggcagaggacgtccacaaacaccacaggaagccgccacccaggggcgtggaaaggcccaatgcctcgtctgggattcacggccggcaaagcggcccctccggaacgggacagcacagcggctcacctctgcgcctctgggggtgcggggggagcctcgccctccacgctctctgggggaccgcccgccctagcccccgcctgggcttcgcgggtggacggttgggggccccgggcgccccccagcgcgtagcttttctccttctcgtgggtcttctggtgctcggctagggccaggctgaagtggaaggtcttccagcagccctgacaggcgtagcgcttccggccgccatggctgctgtggtgctccatcaggtgcgagagccacgcgaaggcctccccgcactcgccgcaggcatagggcttcccgcgggacaagcccggctcgtcagccccagggccctgcccggcctccagccctgcgctgtcgccggagctagagacgccctcgaggctctgcccgtccccatcctcggggtgcggcctcttggttcccagtttcgccgtgcccctgtccggggcaggctgctggatgacggactgcctctgcgatccggtggcagagtcggactccgcgtcctgggggtcctgcgggtccggggccttcccaggctgctcttcctcctcctcagtggtgcccgacgggggatcggcaagggcgtccccagggggcgcctccgtaggcagctcaggcagcacccccgcgggggcggcctcctcgcaggcgcacccagcgctctcctgccgcctcccgccttctggaacaaggtcagagccctagcgtgagcgccccgcccagggccagggagaggaggacccagccgagcctcagctgccggaacagcgcacagggctccgggctctggatccccgcggggctcacggctgtttggaagcagcgctgtccctcccaggcagccctgcagcgcatgccccgcgcctgctgctgcagatgtgggacctggaggcctccaacaacggaggccaccgacaggacaggaaggacagccccactgagcccgggttctggaaaccgcgcctttggaggtctccacctggccactagcttggccacaagatgcacgatgcaaggagagcctgctcagagcgcaccctcctggagggaggggcccggctgccagcgaagagagtggggtcaatagctaaggccaaaccccccagcgacaagccccctggcgacaggcacccagggccctccagcccaagtccgcctctaggtgttcttgttggtgtgctggcacagagcctccaatggggcagaacggccacccccgggaccagtcatacacagatcctggcaactaacaccactgccgtttccaccgaccaagtcttggggtggtctgtcatgcagcaagagaccatggacgtaactggattcctgcctcactcagacacggtggtgggagaatggtgaagcagtcaatgctgaggtctttgctggggctgatggcgctgggaggggccccctcagcctctgaagaaaaagcaaaccccacccggccctaacaccaattcaacccaacctcacctgggaggctgcttccttgtggatctctttccaccaaccggagttcctcagtgtccagcctggaggcagcgtcaggctgggaaagctgataccctgagtggggttaaaaaccaaagaaataaaaggcatcaacacag

SEQ ID NO: 201505 - DNA, 3643 bp, Homo sapiens
  Payload ID: 19765
  Gene Name: zinc finger protein 136
  Uniprot ID: P52737
  ENST ID: ENST00000343979
  CDS Start-End: 141-1763
tttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaagtacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgtagtctctagaaaatacataacctgatggaaatgtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaacctacttgcttcatttagcaggttcttgattccctttccacattatatacattccatcatatttattggaacagctccttttttttccttttttcttttttctttcttcttttttctttttgagacagggtctcgctctgtgctctgttgcccaagctggagtacagtggcatgatctcggctcattgcaacctctgccttctgggttcaagtgattctcccaccttagcctcctaggaagctgggactacaggcatgtgccaccacacctggctaattttttgtatttctagtagagatggggtttcaccatgttggccaggctggtagaactcctgacctcaagtgatccacccacctcagcctcctaaagtctgggattacacgtgtgagccatcacacctagcccattttttttttcttggctcaaataattttattttgcttcctattaaagagttgttgttaattctaagtatgtaaagtttatcacagactgtagtctcgtgaattattattttaacctgttgttctttactccttgttatttattctggctgctctttgtataattgattttgggataaggagacagctatgatagaataataaaatctaaaatgggagatgcctttc

SEQ ID NO: 201506 - DNA, 478 bp, Homo sapiens
  Payload ID: 19765
  Gene Name: zinc finger protein 136
  ENST ID: ENST00000439995
  CDS Start-End: 212-478
tttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatgggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactccttt

SEQ ID NO: 201507 - DNA, 565 bp, Homo sapiens
  Payload ID: 19765
  Gene Name: zinc finger protein 136
  ENST ID: ENST00000418338
  CDS Start-End: 488-565
gtggctcgcctggagtctctgtggcgcggtttcctgtacctgccttgggatccggagggaggaagctgggacacccgggagtcaggaaatgatattgtgctttcattgtttatttttcaacaaagcaatggattactctttcatcaagagacggagtttcaccttgttagccaggatggtcttgatctcctgacctcgcgatccgcctgccttggcctcccagagtgctgggattacaggcgtaactgtacccggcctcaaaaaaataattttcgtctgataaatgtgggtccttttaaatgaacgggcacatagagacattcaagtgatacagcaatcaccttctaactccctgaagctatgaattcatcttttgaaactgctattgccacaagactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacac

SEQ ID NO: 201508 - DNA, 474 bp, Homo sapiens
  Payload ID: 19765
  Gene Name: zinc finger protein 136
  ENST ID: ENST00000425827
  CDS Start-End: 347-474
tttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatgaaaaaatgacatcacaggtcagaaccttacatcgacttggtgagtggttgctggtgagaattaagaccctggaggagggagcatttccacactgagaaggggacagtagggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaaactaa

SEQ ID NO: 201509 - DNA, 1141 bp, Homo sapiens
  Payload ID: 19766
  Gene Name: zinc finger protein 138
  ENST ID: ENST00000307355
  CDS Start-End: 182-1141
ggagcggacatgacgtcttccgggaggcggcggggtctttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggacctgattacctgtctggaacaaggaaaagagccctggaatatgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaa

SEQ ID NO: 201510 - DNA, 2679 bp, Homo sapiens
  Payload ID: 19766
  Gene Name: zinc finger protein 138
  ENST ID: ENST00000359735
  CDS Start-End: 182-484
ggagcggacatgacgtcttccgggaggcggcggggtctttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggctgtagcatttacctttgatctcagtggactcaacattttgtcattccaaagtatcctgccatttgtttcagcactttatgtcatgggaaacagaaaccagtgtctgcaaaagcacctagaagccagaaataaagatctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaattactgtcaaaactcag

SEQ ID NO: 201511 - DNA, 2574 bp, Homo sapiens
  Payload ID: 19766
  Gene Name: zinc finger protein 138
  ENST ID: ENST00000437743
  CDS Start-End: 249-1112
gtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatggccagaaaaactgggaaaatcacaggctcttccacttactggatatttaacaagatattcttcttgagccaaaaacattgacattagcgggaccactgacatttatggatgtggccatagagttctctttggaggagtggcagtgcctggacactgcacagcggaatgtatataggcatgtgatgttagagaactacagaaacctggttttcttggctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaa

SEQ ID NO: 201512 - DNA, 1066 bp, Homo sapiens
  Payload ID: 19766
  Gene Name: zinc finger protein 138
  Uniprot ID: P52744
  ENST ID: ENST00000440155
  CDS Start-End: 145-1026
tttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaag

SEQ ID NO: 201513 - DNA, 2230 bp, Homo sapiens
  Payload ID: 19766
  Gene Name: zinc finger protein 138
  ENST ID: ENST00000440598
  CDS Start-End: 142-330
gtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggccagacctgattacctgtctggaacaaggaaaagagccctggaatatgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaac

SEQ ID NO: 201514 - DNA, 842 bp, Homo sapiens
  Payload ID: 19766
  Gene Name: zinc finger protein 138
  ENST ID: ENST00000494380
  CDS Start-End: 145-525
tttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggacctgattacctgtctggaacaaggaaaagagccctggaatatgaagagacatgagatggtggtagccaaacattcagctgtagcatttacctttgatctcagtggactcaacattttgtcattccaaagtatcctgccatttgtttcagcactttatgtcatgggaaacagaaaccagtgtctgcaaaagcacctagaagccagaaataaagatctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaa

SEQ ID NO: 201515 - DNA, 2949 bp, Homo sapiens
  Payload ID: 19767
  Gene Name: zinc finger protein 14
  Uniprot ID: P17017
  ENST ID: ENST00000344099
  CDS Start-End: 140-2068
attcctggcccatgggaagattgcgtttcacctgctcctgaaggccgaaggtggctctagcgcatcctttgtcgcgccgtgacctgcaggtactgacagatccgtagggaggacaccgtgacttcccggacgctgggaaatggactcagtctcctttgaggatgtggccgtgaacttcaccctggaggagtgggctttgctggattcttcacagaaaaagctctatgaagatgtgatgcaggagaccttcaaaaacctggtttgtctaggaaaaaagtgggaagaccaggacattgaagatgaccacagaaaccaggggaaaaatcgaagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatcttat

SEQ ID NO: 201516 - DNA, 3550 bp, Homo sapiens
  Payload ID: 19768
  Gene Name: zinc finger protein 140
  Uniprot ID: P52738
  ENST ID: ENST00000355557
  CDS Start-End: 1284-2657
tatggattagccattctttattcctttactttcctaataaacttgctttcaccttatggattcgcctcaaattctttcttgtgcaagatccaagaaccctctcttagagtctgagatccggacccctttccagtagcaaaaggtcttagactgaagtactgactccacagtcgttgttaagaatcctagttgtttaatagaggcggtcttgggctcttgctgggccgcggtgtgttctgggaagtgtagtcacctgagtctccagttccttgtctctgggccgtgtgtgcacgccagcgaagcactgtgggagtcgtagtaggggaggaaaaccctataccctctggcgtgcggcgcaggagtttgggggaatgtagtcgccagagctctgcgttgtcttccggctttgggcgtggccacgatgcactctgggagtcgtagtaggggaagaacgtcctccgctcttttgcgcacggtcgctagaggttctgggaagtgtagttgcctgaagctcgtgttctttgtctttcgatgatgtgcgcttggcctcaaagcaccctgggagttgcagtggggcggggaaagccatatgctctctcgcgcggggtcgcggttgtttctgggaagtgtggtggcctgagttccacgttcttcgtttctccgctagttgtgcgcttggccgcgagacactctggcagttataggaacacaaaggtctgtgtactcttccgcggggggccgcggttatttctgggaaatgtagttgcctaggacccgggttctttgtttctcggctctgggcgtgggaggatagcccctatgctctggcgcaccgggccgcgatggctctgggaattgtagttgtcgcaggccctcgttctttgtctcctggcgttctgggcacggcagcgaggcgctctgggagttccagtaggaacgaaaagcccttgcgcgcagggccgcattggtttctgggaattgtagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacataacaaagtgt

SEQ ID NO: 201517 - DNA, 529 bp, Homo sapiens
  Payload ID: 19768
  Gene Name: zinc finger protein 140
  ENST ID: ENST00000392041
  CDS Start-End: 157-390
ggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggacttgggacgtggctttctttctcctacaaccacctgcctggcagaaccccaggaccctgtcccttgttcctccttttcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgac

SEQ ID NO: 201518 - DNA, 553 bp, Homo sapiens
  Payload ID: 19768
  Gene Name: zinc finger protein 140
  ENST ID: ENST00000412146
  CDS Start-End: 292-553
gcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctgga

SEQ ID NO: 201519 - DNA, 1663 bp, Homo sapiens
  Payload ID: 19768
  Gene Name: zinc finger protein 140
  ENST ID: ENST00000440550
  CDS Start-End: 190-495
gtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaa

SEQ ID NO: 201520 - DNA, 1945 bp, Homo sapiens
  Payload ID: 19768
  Gene Name: zinc finger protein 140
  ENST ID: ENST00000429434
  CDS Start-End: 1462-1945
ggaccctgtcccttgttcctccttttcaggtgcttatacttaagtatacatgaagagagtgacaggaagctatccagatgtgggcggggtttctgacctggctggcatgttttagggtgagagggtagggtgccagctgttacatcgcctcctctttcccacagtgttagaatgaggagtgctttacgttactccagcgcccctttattcatttattcaatatgtttttactgaacctctactttcagtggttcccacagtgtgatccttggaccagcagtatcagcatcatctgagaacgtattagaaatgaatattcttgagtcctaccccagaccttctgaatcagaaactgagaatttggcccagcagtctaacagtccttccaagtgattctaatgtgcaactcattctaagtcttgaggatgcagaagtgaccaaaacaaaatctccgaatcctcagagctcatttttcagacatgacataaggaacacatttttattttgatttggcctaagggcttggctggtaattgtgcttcacagcagtggggataacagggtcaactattcaaaatgagtccctcatttcagttccacttctttatcctactttttgtcatacttctctccaaattcagaggttctctgagttttgctggggaatccaatttccacctctgctgcagatcttgctgtgtaggaaacagctgctttattagtcaacagtctttaatcacttttttattaaacttcaaaactgtaaattataactgccatccatctgggactgctactagtttgagacattttaaattcccattcatgccttatagatcaatgtggatcactcaagtggtgcaaaaccaggctgcaaagcaagggcttatatattattccccctaactctgagggaaagtgctttaggttctgtcctgggaggtattacattctcttcttgcggaatcaagattctttattgcttatcctccttgttctgtgacattgctaaaattaccactaagtttcacaggtatttctttaggattagggataactgtgacaaacttgagactgtatgccccatttgaagggtggtgctgttatctgctgtagcgaattattaccctgaagaaattctggctgaattatattaaaataggctggtattaaggaaaatatacattgtttattaacataaaggaatactgtaaaatcttaagaatttttacaaccaatgccaaaaatccatattgttcatgtgtataatcctttattttgaataaaattgtaaattatctcaggacagataatttatgtttttctccttttctccagttatacaacaaaacacaagagctaggctcttcattatataattactcagaattctgaaaactctcactgttactacttagacacattgcctaacctccacagtgagactcattttattccttgatgagggagtttgggggcatgcgtgctggtcatgcaaatatctgtccgtcatttcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaag

SEQ ID NO: 201521 - DNA, 596 bp, Homo sapiens
  Payload ID: 19768
  Gene Name: zinc finger protein 140
  ENST ID: ENST00000319849
  CDS Start-End: 190-534
gtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactggcaggtctttccatttctaagccagatgtggtttccttattggagcaagggaaagaaccctggctggggaaaagggaagtgaaaagagatctgttttcaggctttttttcagctaactgtgtcagcttctttagctgggcccatgtcgacggctccgctttcttggtagatggaaacttcttttgtaagtttttcagagtcaagtggtgagatcaaagacttttcaccaaaaaatgtcatttatgatgactcatcccagtatttgatcatgg

SEQ ID NO: 201522 - DNA, 2328 bp, Homo sapiens
  Payload ID: 19768
  Gene Name: zinc finger protein 140
  ENST ID: ENST00000536790
  CDS Start-End: 111-350
gaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcaggtaactgaagtggtgaaaaactacagaggagaggactactgtaattcccagccttgttcctttatagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaa

SEQ ID NO: 201523 - DNA, 726 bp, Homo sapiens
  Payload ID: 19768
  Gene Name: zinc finger protein 140
  ENST ID: ENST00000356456
  CDS Start-End: 378-726
ctgagttccacgttcttcgtttctccgctagttgtgcgcttggccgcgagacactctggcagttataggaacacaaagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagtt

SEQ ID NO: 201524 - DNA, 2340 bp, Homo sapiens
  Payload ID: 19768
  Gene Name: zinc finger protein 140
  Uniprot ID: P52738
  ENST ID: ENST00000544426
  CDS Start-End: 401-1465
ctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacat

SEQ ID NO: 201525 - DNA, 2970 bp, Homo sapiens
  Payload ID: 19769
  Gene Name: zinc finger protein 141
  Uniprot ID: Q15928
  ENST ID: ENST00000240499
  CDS Start-End: 150-1574
cagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgagaaaatttatactgtagagaaaccctggaaatgtgaagaacgtggcaaagttctttacctcattctcaaaccttgataaacataagagaattcataccggagagaaactgtacaaatgtgaagaatatggcaaagcctgtgaatggtccacaaacctgaatgagcagaagaaaattattactggagataaaccctgcaaatgtaaagagtgtaacaaaacctttaaacagccctcaccggtgaataaacataagaaaaatcatgctggagggaagccctacacatgtggcagaatgtggcaaagcatttaattggtcctcaatgcttaataaatataattcatgctggagagaaacttcacatgtgaaccgtgtggcaaagcctttaaatggtcctcaacccttaatgaacgtaagtgaattcatgctggagcaaaatgcttcacatgcgaagaatgtggcacagtctttaccacatcctcaaactttgttaaacataagagaatttataccagagagaaaccctacacatgtaaagaatgtggcaaagccttcaataggttctcaacccttactgtgcacaagataattcattctggggaaaaaaatgctacaaatgtgaaaaacgtggcagagccttcagaccatccacaaacctttatgaaaattcatatttgagagtagaagattcattccacaaacttacattgagaagatatgaaagatgaatataagaattcatcctagatataaaaccatagaaatgtaaaagatgtgacaaaacctttaagccatactccaggcttcttaaacataatgagaactcatactggaggaaagtcttacaaatgtgaagaatgtggcagtctttaaatcttcctcagtcttttctaatcataagataattcacactgaagagaaactgcaaacgtggaaagtgtgacaaagcttgcaaccacactcaatctattctaaatataagagaaatgatattggtgagaagccacaaaaatatgaaaaatgtggcaaagccttcaaatgcttgtcacatcttactgtatatatataattcctactgaagaaatcccctggaaatgcaaaaaatgtggcaggatttttaccaatgctcatctttttgcacatgatatcctttatattcgagaaaagttatagaaatataaaaaatatagaaaagtcatatctcctcacattttactaactagcaatgttcatacttaataaaaacattataaatgtaatttctgttgaaagacttcagaaaatataggcctttaaagtgaagaagagtattcttaagacaaacaataca

SEQ ID NO: 201526 - DNA, 2146 bp, Homo sapiens
  Payload ID: 19769
  Gene Name: zinc finger protein 141
  ENST ID: ENST00000505939
  CDS Start-End: 151-492
ccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggcccggctgagcccagcctaaatttctaaccagctcaatcctgagctagtatgtttcgggattgttatgcagttataagttagtaatatatacacccattaaagacaggatctcaggacagattgatcacaaataacctgcaaatgcttgccaccctgtaagtattgattttcttttttcctttatttaaagttagatttgttgtaagatgatattgagttacacagaagttaggcaggagaatagggtttggaggcagggaacttaaggccaattcgtgctgacttcctacaagaaaaaacaccaaggtctgggagcagggaacctaaagccagttaacgtgaacttcctacatctaaaccaaaaggaaagacctcatctacacccgagtagcaaaggatcgaaggcgactgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagataaggggtagctgataggaacctcaaaaggagtacttaaaacccagaaaacattgtaaccgggtccttgggcggcttgctggggctcacacccaccctgtagagtgctttctcactttaataaaatcttgcttttgctattcccttcctgtttttcattcctttgtgtgctttgttcaatttttttgttcgaaatgtcaaggacctggacagttcacactcacggccttccttctggtaacagaagtgcaggtatatgtggatgcatgtgattggtacttaaactcacacagtgccccataccacaggagaaaaacacacagttccagcctggcaattaggtccaaagataaatagcaaaacaagaagtttgcctttaatctattccctccacatctaaactctggagggcaaggctgtgaggagatctgaagacatggtgctctctcttcctgtggacccatcattccttgtttaccatctgatatttgaaaagaagaggaacccctgagaaaggaggcagaggctggttaggaagatagggagggaaggtcttgggagatgaaaaacacccacgggaccacacctgcaccacccatgtagctagcaggaagaaatgtggttaagaacttcctcttatgccagggtgttgatcagaagagactgtcccacttaggcccaggtgtaatgaatcaacctaaatgtcattaacttgacccagctccttataatgttactaacatgacataaatattttggttttagcttcactctttccacctgctgtcggttttgcttgggcactcatgggtaataaccaagatggagtcactgtggtcaactccaggcatgcacagatacaacacccttagcggggaaatttacccctcccatttgggcagaacccacagaagacttcctcgttcttgccacataaaagacccagaactcagccccatttctggcaacctgctttcatgtcccctttctgctgagagctttccttttgcttaataaatcctattctgcttta

SEQ ID NO: 201527 - DNA, 1611 bp, Homo sapiens
  Payload ID: 19769
  Gene Name: zinc finger protein 141
  ENST ID: ENST00000512994
  CDS Start-End: 165-770
gcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggcccggctgagcccagcctaaatttctaaccagctcaatcctgagctagtatgtttcgggattgttatgcagttataagttagtaatatatacacccattaaagacaggatctcaggacagattgatcacaaataacctgcaaatgcttgccaccctgtaagtattgattttcttttttcctttatttaaagttagatttgttgtaagatgatattgagttacacagaagttaggcaggagaatagggtttggaggcagggaacttaaggccaattcgtgctgacttcctacaagaaaaaacaccaaggtctgggagcagggaacctaaagccagttaacgtgaacttcctacatctaaaccaaaaggaaagacctcatctacacccgagtagcaaaggatcgaaggcgactgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagataaggggtagctgataggaacctcaaaaggagtacttaaaacccagaaaacattgtaaccgggtccttgggcggcttgctggggctcacacccaccctgtagagtgctttctcactttaataaaatcttgcttttgcta

SEQ ID NO: 201528 - DNA, 813 bp, Homo sapiens
  Payload ID: 19770
  Gene Name: zinc finger protein 142
  ENST ID: ENST00000432460
  CDS Start-End: 771-813
acaaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggaggtgagtgagcggctgcggggcggaactgggaagggaatgcgggtggagcgagctggaggcaaagtttttcgagccccgggatcagggtgggcctgggcgctgggaactctcggaaggaggtactgaagggagcacccagacgagctgggccccggcgctgcagtcgcgtcacggttctggaccccgcccgggtacctgctgctctcaggacaaaatcatgacgatgctccatcccaagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccg

SEQ ID NO: 201529 - DNA, 6028 bp, Homo sapiens
  Payload ID: 19770
  Gene Name: zinc finger protein 142
  ENST ID: ENST00000450765
  CDS Start-End: 649-945
atctacttcccgccacacccacagagaagcccacgccactctaccccagagctctcgatggtgcttctccggcttcagggctggagtgggggtggagggcgggaaaaaccacagagacaaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagccactgcagcttcataggctccaacgtcaaactcttccggcagcatcagcggagccatggtgctgggacacagggagaactttctgccgttcagggccttccatcccaggagctgctgccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataa

SEQ ID NO: 201530 - DNA, 5926 bp, Homo sapiens
  Payload ID: 19770
  Gene Name: zinc finger protein 142
  Uniprot ID: P52746
  ENST ID: ENST00000411696
  CDS Start-End: 445-5508
gacaaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggaggtgagtgagcggctgcggggcggaactgggaagggaatgcgtctgtcctttctcttcctcagccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaac

SEQ ID NO: 201531 - DNA, 373 bp, Homo sapiens
  Payload ID: 19770
  Gene Name: zinc finger protein 142
  ENST ID: ENST00000450560
  CDS Start-End: 294-373
atcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgcatttaagaagccaaaacacacaagtcggtggtgatgacagacccccttttggactcacagccagccagtagcaccggggagatggatggactgtgccctgagctattgctgat

SEQ ID NO: 201532 - DNA, 5800 bp, Homo sapiens
  Payload ID: 19770
  Gene Name: zinc finger protein 142
  ENST ID: ENST00000433921
  CDS Start-End: 421-717
gagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagccactgcagcttcataggctccaacgtcaaactcttccggcagcatcagcggagccatggtgctgggacacagggagaactttctgccgttcagggccttccatcccaggagctgctgccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataa

SEQ ID NO: 201533 - DNA, 5909 bp, Homo sapiens
  Payload ID: 19770
  Gene Name: zinc finger protein 142
  Uniprot ID: P52746
  ENST ID: ENST00000449707
  CDS Start-End: 423-5486
ccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaa

SEQ ID NO: 201534 - DNA, 880 bp, Homo sapiens
  Payload ID: 19770
  Gene Name: zinc finger protein 142
  ENST ID: ENST00000440934
  CDS Start-End: 1-880
gccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccaggtgtcctggtaaaggtggtggaggtgtacttctgtgagcgctgtgaacagagcttcgcagagcccactctgctggccctgcaccagtgcagtgagacccatatacagcctgtgcagggcctctctagccccccatgctctgtagagctgcctcccagcaacccaaccctccctggccctctgcagggccagagcccgccagttagccccctatcatgccctgtgtgtagacaggagtttgcccaaccccaggccctgaagagccacttcaagattcaccggggcactcctgacaccttctcctgcccagaatctggctgtgtgttctctgctgaagatcgcaagggtctgcagcaccacctgaggcagactcacagagcagttcctgtgccctgttctttccggggctgccccctgcttttcgggagccagcagggcatggagctgcaccggcaggcgcattaccctttccactgcagccactgcagcttcataggctccaacgtcaaactcttccggcagcatcagcggagccatggtgctgggacacagggagaactttctgccgttcagggccttccatcccaggagctgctgccagctcccaaactgcctccaggagagaga

SEQ ID NO: 201535 - DNA, 2562 bp, Homo sapiens
  Payload ID: 19771
  Gene Name: zinc finger protein 143
  ENST ID: ENST00000299606
  CDS Start-End: 62-1894
ctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtaatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggtt

SEQ ID NO: 201536 - DNA, 1954 bp, Homo sapiens
  Payload ID: 19771
  Gene Name: zinc finger protein 143
  Uniprot ID: P52747
  ENST ID: ENST00000396597
  CDS Start-End: 98-1921
gcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaagga

SEQ ID NO: 201537 - DNA, 2947 bp, Homo sapiens
  Payload ID: 19771
  Gene Name: zinc finger protein 143
  Uniprot ID: P52747
  ENST ID: ENST00000396602
  CDS Start-End: 120-2036
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgtta

SEQ ID NO: 201538 - DNA, 2696 bp, Homo sapiens
  Payload ID: 19771
  Gene Name: zinc finger protein 143
  Uniprot ID: P52747
  ENST ID: ENST00000396604
  CDS Start-End: 342-2255
cattcagcaatcgccagacaaagcccttctggtctgcagaacgcactccggcaagcccaccgggagaaccaaagccgcctcctcgcccctgtggggaaaatggcgctcgtcaccccggctccctcccgggtaatcacaaggaccagcctccctccctcgctacaaaatggcgcctcccgctggggccccagaatcggtatgactcgctagtcagtgaggcggggtccgtctgggataagcggttatgtcaaccagtcagacacaggagctttgattctgcactttgcgcgagccactcaggggcgggctgtaaagtcaggcttggctgacgtcagtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtagggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcag

SEQ ID NO: 201539 - DNA, 554 bp, Homo sapiens
  Payload ID: 19771
  Gene Name: zinc finger protein 143
  ENST ID: ENST00000412390
  CDS Start-End: 128-554
gttggaaaattttctcggagaaacgtggcatggctgcattgaactgtgcctctactacatggttttatttttaaaataaaaaaccactccaccctcatagcatagttccatttctggaaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtagggacagtttgcgtctagaggatggtcaagcagtacagttagaagatggtaccacagcatttattcaccacacctccaaagatagttatgaccagagtgcattacaggcggttcagctggaagatggtaccacagctt

SEQ ID NO: 201540 - DNA, 265 bp, Homo sapiens
  Payload ID: 19771
  Gene Name: zinc finger protein 143
  ENST ID: ENST00000417726
  CDS Start-End: 47-265
cagaagatacttgtgttttcctgtagttgacaaaaaacggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcata

SEQ ID NO: 201541 - DNA, 551 bp, Homo sapiens
  Payload ID: 19771
  Gene Name: zinc finger protein 143
  ENST ID: ENST00000414370
  CDS Start-End: 301-551
aaaaaaaggttactgaggtctaacatcggatattagaaatttacaattttatcctcccttttctccagttttggccaaaagagtgaacaaattcttataagtctctttgaaacgtattattgtggaacgcgaactagtttttattccttccccttttgctttggacatttgttttttccacataataacgaagttaaaaagaggaaagaagaataccattgccagcccattatttgtttaaaatcagcgtcagcctttgctttggaagtgtctaaatcagctgatataatcaagtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttc

SEQ ID NO: 201542 - DNA, 502 bp, Homo sapiens
  Payload ID: 19771
  Gene Name: zinc finger protein 143
  ENST ID: ENST00000447186
  CDS Start-End: 1-502
tgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcaggtgagtaccaaggcatactgtcctcagtcgacagcagtgctgctcatagctttcaactttgtacactgtgcttcgtgtataacctttacagga

SEQ ID NO: 201543 - DNA, 644 bp, Homo sapiens
  Payload ID: 19771
  Gene Name: zinc finger protein 143
  ENST ID: ENST00000438144
  CDS Start-End: 75-644
ggccggacggctgtttcctgtcctggtgcatggtggtcggacgaaggaattgttggaaaattttctcggagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaag

SEQ ID NO: 201544 - DNA, 563 bp, Homo sapiens
  Payload ID: 19771
  Gene Name: zinc finger protein 143
  ENST ID: ENST00000496276
  CDS Start-End: 73-333
acggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaaggatcactggatgtgttattgaattgcctcagaacattgagggaagaatcaagatgaacacgagcttaagttgtatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatg

SEQ ID NO: 201545 - DNA, 2022 bp, Homo sapiens
  Payload ID: 19771
  Gene Name: zinc finger protein 143
  Uniprot ID: P52747
  ENST ID: ENST00000530463
  CDS Start-End: 109-2022
agacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtagggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaa

SEQ ID NO: 201546 - DNA, 548 bp, Homo sapiens
  Payload ID: 19771
  Gene Name: zinc finger protein 143
  ENST ID: ENST00000532577
  CDS Start-End: 96-548
atgcgggttgcggggcctgggggccggacggctgtttcctgtcctggtgcatggtggtcggacgaaggaattgttggaaaattttctcggagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtagggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccg

SEQ ID NO: 201547 - DNA, 575 bp, Homo sapiens
  Payload ID: 19771
  Gene Name: zinc finger protein 143
  ENST ID: ENST00000534265
  CDS Start-End: 51-575
cctggtgcatggtggtcggacgaaggaattgttggaaaattttctcggagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctaca

SEQ ID NO: 201548 - DNA, 555 bp, Homo sapiens
  Payload ID: 19771
  Gene Name: zinc finger protein 143
  ENST ID: ENST00000531943
  CDS Start-End: 148-555
accgcatggcgatgcccgggagactggagaagctcaggcaggcttggaagccaatccccggcatacagcagctctcgggaatgcagagccctagagcaagaccaagggcctcggccgacactgagagcctccagggagaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcag

SEQ ID NO: 201549 - DNA, 627 bp, Homo sapiens
  Payload ID: 19771
  Gene Name: zinc finger protein 143
  ENST ID: ENST00000533542
  CDS Start-End: 103-627
actatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatgcaaaactcatagatggccaggtcattcagttggaagatggttctgcggcctatgttcaacatgtacccatacctaaaagtagggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaa

SEQ ID NO: 201550 - DNA, 565 bp, Homo sapiens
  Payload ID: 19771
  Gene Name: zinc finger protein 143
  ENST ID: ENST00000526657
  CDS Start-End: 68-565
cggctgtttcctgtcctggtgcatggtggtcggacgaaggaattgttggaaaattttctcggagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagttatgaccagagtgcattacaggcggttcagctggaagatggtaccacagcttatatccaccatgcagtgcaagtcccgcagtctgacaccatcttggcaattcaggctgatgggacagtggcag

SEQ ID NO: 201551 - DNA, 3326 bp, Homo sapiens
  Payload ID: 19772
  Gene Name: zinc finger protein 146
  Uniprot ID: Q15072
  ENST ID: ENST00000443387
  CDS Start-End: 993-1871
gacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagagaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaa

SEQ ID NO: 201552 - DNA, 3780 bp, Homo sapiens
  Payload ID: 19772
  Gene Name: zinc finger protein 146
  Uniprot ID: Q15072
  ENST ID: ENST00000456324
  CDS Start-End: 1450-2328
aggactcccagacccctcaccttctgcctcccctggtcgcgtccgggtccttgcggagctaactagctcgccacgacgtcaagaacgacgtaacgtcaggccgctgtgggctctgggaattgtagtccagagctagatcggccacggacagaatggcgttctcttatctctgagtcggggcctggctcgttttgacatttttgcgcccacgagtcttcggagagggcgtcgccactccagaccttccagcaagcttgaagtcatctgacgctaaaggactacttacctcaagagctccatcgtcacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagagaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatcc

SEQ ID NO: 201553 - DNA, 9651 bp, Homo sapiens
  Payload ID: 19773
  Gene Name: zinc finger protein 148
  Uniprot ID: Q9UQR1
  ENST ID: ENST00000360647
  CDS Start-End: 487-2871
ggcgaccgcggcggcgctctagctgcggcatgtctgcgtctctactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttataccatgaatgtttttttttaatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttctgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcagtatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaatggaaatatttgatgaatactgagagttcctaaaatgctagagcaaatttccgagggaaaggggggcatcgtgtgtcttgggaaggttgcagcaggttgtttcttcaactccctaagaaatcattgggaaggactcaactgcaaactcgggatcagatacaaaatgggtctttccttcccctctcccccaaaaaataggagcactaaattttaaaatctactcaggtgacagttgctttgcaatgaaacttatcacattgaaattttcagtgttaaataaaaagagatttgtgatatttttaaatataaacttttacatcagtagtcagcagcctgacaattgaaatttggtaagtcgatatattttaaaatattttgctctccaaatagaattgtttttaaacaattgggaggttttttgtttctttaaatatgttttaattgtcattgtaaaaacaaaatcttgcttgaccctatattatgccatgaatgaattgctgagcctttataatacagtgacagcttgtttcatgcatagtcatggaacatagagatgttctttaaactgacctattgataagaggtttaatgagtttcacggctttcaacactattgtcatatagttatctttgccatttggagtttataaaaccattttatgtattgtgatactaaaggaagttgttttgctttactttaaattgaattattagactaatatttgcaaattctgcattttaaatgtggacactggctgtttgaaaaataaaatatagaatacagttttatggataattttcgagctgaatttttcacaatattctgaaccaaataacgaatggtaaatatgcaaaaatcatggtgcatagatataaccgtaaagagaaaagaatttctgtgtggaattaacagttacacaaattgggtaacaattatcagggcctttattatagctttatgtggaatgttattctaaaatgcaagagtcaaatgttactgtcattgaatattttagacttgaaacgtgtttatcatagagcgaagaaaatatgtgttcttttctttacagataagactctgttaacccactgtcagcatacgtgggatttcttttcttttttctttcattagtggagatttgttttcatccatctaccaccttgccagtaccctagcttgtgaccagcgggatgcattgtaagaaagttgtctgtggttaggagtgcagtctgggtccatggaacaaatttaaactaattggccctcgcaatgatcagtcctaggaccctggccttattattagcatggtgctttaaccaattgtacataataataccactgatagtctactaatgcatttcctagatcccagtttttcttgaatgattaggaatggtggggagaggggaggggagatattctacatgatacttctccaatcttctaaagattataagaaaaaataaaaaattgaagtcacttgaattaatgtgttgtcattgagtcttactcgacaatttatcatgcacaaagtgattatgaagattttcctgattatatgtttggattgaatttaaaaattttttttttcag

SEQ ID NO: 201554 - DNA, 566 bp, Homo sapiens
  Payload ID: 19773
  Gene Name: zinc finger protein 148
  ENST ID: ENST00000465763
  CDS Start-End: 317-566
ctgtgttctgcagcgttttgttggatactattgataactggttctttaaggaaaggggcttaaacaggccttggtttgtagaggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatg

SEQ ID NO: 201555 - DNA, 2949 bp, Homo sapiens
  Payload ID: 19773
  Gene Name: zinc finger protein 148
  Uniprot ID: Q9UQR1
  ENST ID: ENST00000492394
  CDS Start-End: 303-2687
ggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaa

SEQ ID NO: 201556 - DNA, 763 bp, Homo sapiens
  Payload ID: 19773
  Gene Name: zinc finger protein 148
  ENST ID: ENST00000495019
  CDS Start-End: 538-763
ggaggaggaggcggaggggcgcggagaagctggcgcactttgggcctcggcggggtcgtctgcggcggccggacctcccagataccgcgccttctgggcctgccccgctggcgcagtcaggaccccttccctcaacgggatgggaaactttgtgagtggcttctccgcagccactaacaagtgtccgccagacagcgggggggccgccgaaggctgatgatggacacccgtttttcttcttattcctcttttacaaatcttctgttgaactgcattgtgtttacagtttcacgtctgtgaaaaggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatat

SEQ ID NO: 201557 - DNA, 566 bp, Homo sapiens
  Payload ID: 19773
  Gene Name: zinc finger protein 148
  ENST ID: ENST00000471196
  CDS Start-End: 490-566
aggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggcacacctctacattgtgttcagtgcctagtgtaattctgggcatgtattctagacagagtagatcggattggttctggcattgaataaggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaat

SEQ ID NO: 201558 - DNA, 1025 bp, Homo sapiens
  Payload ID: 19773
  Gene Name: zinc finger protein 148
  ENST ID: ENST00000468369
  CDS Start-End: 309-743
ggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtgaaaaaccatttcaatgtagtcaatgtgacatgcgtttcatacagaagtacctgcttcagagacatgagaagattcatactggtgaaaaaccatttcgctgtgatgaatgtggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaa

SEQ ID NO: 201559 - DNA, 2952 bp, Homo sapiens
  Payload ID: 19773
  Gene Name: zinc finger protein 148
  Uniprot ID: Q9UQR1
  ENST ID: ENST00000484491
  CDS Start-End: 303-2687
agaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagtt

SEQ ID NO: 201560 - DNA, 2960 bp, Homo sapiens
  Payload ID: 19773
  Gene Name: zinc finger protein 148
  Uniprot ID: Q9UQR1
  ENST ID: ENST00000485866
  CDS Start-End: 563-2947
ctactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcggggtcttattctgtcacctaggtggagtgcagtagtacagtcacagctcactgcagccccaacatcctgggctcaagccatcctcctgcctcagcctcccaagtagctgggaccacaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaa

SEQ ID NO: 201561 - DNA, 2375 bp, Homo sapiens
  Payload ID: 19773
  Gene Name: zinc finger protein 148
  ENST ID: ENST00000544464
  CDS Start-End: 384-1748
ggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaagtttcaaagtatgcttttgaacttgtggataaacaggctttactggactcagaaggcaatgctgacattgatcaggttgataatttgcaggagggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattc

SEQ ID NO: 201562 - DNA, 5687 bp, Homo sapiens
  Payload ID: 19774
  Gene Name: zinc finger protein 154
  Uniprot ID: Q13106
  ENST ID: ENST00000512439
  CDS Start-End: 198-1511
cggatcagagatagcagagcgccgagttggggccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagcggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctagatgttcatcatcagaagcagcaccttggagaaaaacatttcagaagcaatgtgggcagagccttgtttgtgaagacctgcacattccatgtgtcaggggagccttccacctgcagagaagttgggaaggacttcctggccaagttgggatttctccatcaacaggctgctcacactggggagcaatcaaatagcaaaagcgacggtggggccatcagtcacagaggaaaaactcattacaactgtggagaacacacaaaagcattcagcggtaaacacacacttgttcagcagcagagaaccctcactacagaaagatgttacatatgcagtgaatgtgggaaatcctttagcaaaagctacagtctcaatgaccattggagacttcacactggagaaaagccttatgaatgtcgagagtgtgggaagtcctttaggcaaagctctagtctcattcagcaccggagagttcacactgcagtacgacctcatgaatgtgatgaatgtggaaaattatttagcaacaagtctaacctcattaaacatcggagagttcacactggggaaaggccatatgagtgcagtgaatgtgggaaatcctttagccaaaggtctgcactccttcaacatcggggagttcacactggggagaggccttatgagtgcagtgaatgtgggaagttttttacatatcattccagtctcataaaacaccagaaagttcacagtggatccaggccttatgagtgcagcgaatgtgggaagtcatttagccaaaactctagcctcattgaacaccatagggttcacactggagaaaggccttataagtgcagcgaatgtgggaaatcctttagccaaaggtctgcactccttcaacatcggggagttcacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaattccaggtatgtgtgaactgcattgcaccttttgccctgcccagggcccatgtcagatttatgtctctgctgatactatagtggaagccattttacctctactgcctggcaggtgaccaccagtgtgcaccactcacccatcccagtgtattcaggccatggacctgacccagtttggcccagaggactctgctggtgacctgaaaagagggactacatatttcaggatattgttggtctcacatgactcttgatagagtttgccagccttcaaatcaccaactgtgggaaccaactgcctcttattgccttggtttgtacaataacaaaggccttattaatcttgggggttctatatgtatgggttggtttgaaaacagttgggttctgctaacatgaaggggtgaataactttttttggagatcccaaacattgtgtagctcaacagggacagggacagggacagtaggatggcagaatatagctctctctctagtttgagcctagttttcattgctattcaaggcctctgagaaaaaactacagggtattgtcctaatttatatcctggatgccatagaggtcagcctgaggaggcagcagttacttgacatcctttgatgtttctgaaagcaacatgaaattgttctcttgttcacaaggaatactgcatcgtgttcagtgccagtgggggaaatctgttccccaggtcctgtatgccttgatatcctgaattccacagggtagcaccacaggtggtaagattatagtaggaattataattgttatagaagtactggattgatagagagtggaaaactgcaataacactgcaataaatagaatgtgccccttttacagaggtttccatgatgttcgttattatggctcttaaggatgagcaggtacagaaatcctcaggacctacagaattgtgtatcttgtgtagctgaggtcattgtcagaaattttatggaatcctgtagcctctgggattttcacctcaaggtcattgctatgcaggcaggaaaacaaggatagagaagggaggtctaggccattgatacagcctttgtgatccagccaacatttctgttgagtcaggtggaaatggccttcactgttcacttgtatttgtgatcactgaggcaaaatcctctcccaggacatgaggagagagatggtggaatcaacatagggttgtcaaacctgattttccaaaaacaataggaaattcagacttttattttgaaccatattttgttaggttggtgcaaaagtaactgtggttttgaaccatgatttatttttatttttatttttttttgagtcagagtcttgctctgttgcccagtctggagggcaatggcactatctcagctcattgcaacctccgcctcccaggttcaagcgattcttctgcctcagcctcccaggtagctgggattacaggcacccgccaccacgcccatctgagttttgcatttttagtagacatggggtttcaccatgttggccaggctggtcttgaactcctgacttcatgtgatccacccaccttggcctcccaaagtgctgggatttacaggcatgagccactgcgcccagccaagctttttcaccattccaatttccttcaaatgctgaacagccgtggaatggttgacattgagttcttaggcaacttctcatgtagttgtaagaggatcagcttctaatattgctctcaattggtcattgtcaacttccagtggctggccactacttctcttcaaggctcttgtctcctttgcaaaacttcttgaaccaccactgcactgtacattcgttagcagttcctgggccaaatgtgtttatatcgtgagttgtctctgctgctttacgacccattgggaactcaagtaagaaaatctcagccgggtgcggtggctcacgcctgtaatcccagcactttgggaggctgaagtaggtggatcacaaggtcaggagttagagaccagcctgaccaacatattgaaacctcatctctactaaaaatacaaaaattagccgggcgtggtggcatgtgcctgtagtcccagctacttgggaggctgaggcaggagaatcacttgaacccgggaggcagaagtcacagtgagccaagatcacgccactgcactccagcctggacgacagacaaaacaagactccgtctcaaaaaaaagaggccagatgcggtggcttacacctgtaatcccagcactttgggaggccgaggtgggtggatcacaggtcacgagttcgagaccagcctggccaacatggtgaaaccccgtctctactaaaaatacaaaaattagctgggcatagtggcatgcacctgtaatcccagctactggggagcctgaggcacgagaattgtttgaaccccgggaggtggaggttgcagtgagccaagatcatgtcactgcactccagcctgggcaacagagcaagactctatctcaaaaaaatcgctgaaatttgagttttgtctaacatttccatagtctaaaataaacataaacagcaagtagtaagtcagcaaaaaaacataaagcgagaaatgcctattaaaatgatgtataaccacatttatttaagaatgttttccaatataaaatggcaaaatccaacatgcaaaaacggcaattacttttgcactaacctgataataattttaataagaataaatggtacatatttaaactatataatttgatcagctttgatattcatattaacctgtaattgctcccaccatgccaattttgaaactgccaacatgttactgaatgtagaattgggaagagttgctgatagcatcctaatatattctgtttctaccatactgatacagtggccacgaataacctcaagaatgtagaaaataaaatgtagtgaaatgattaggaagaagttgtttcttcacaatcatgacaatgaacgtgtcattccacaagttacctcattgtcctttaataattatctgcctataggcaactattgatttactttccattataatacattagttttcatttgctagaattttatatgattgaaaccataatgtatttactcttttttaatccctgggtatagtcacgtatttattttgagattcatcattatacctctatgagtagtttcttttttttgtattgctgagaagtatgatgttctgtggatataccagtattcgtttattcattcattcatttgttatggatattttgagtagttttttaaagtagtttgaggtataatggaacttaaagtgcttatatttaaaatgcatattttgatattttcatacatgcttacaccctggaacgcagtttccttctgtctttttagttcattctcaacatataaaattaattttcattgtgtaaaattactggtacaatgacatattttgtctcctgttacagctgtgttcaattacaaaaaaagatggaaaagactgttatgaagccagatgaacctttctccagtcttccttcactatttttttttccttcaccatttatcatttcatagtcatttatgtttcatcggtcctcatgtgtactagtgcgttattttacttatactcccggatatcatattatttaatgcatagcctcttcagaatgcaattttaaaatgtaaaggctcttttataaccccccaaaaaatcacacaaatatattttaaaatgtaaatattttatcgcttctgttttctcagttgtctaaaacaatgtgtttcttaaggaagatcatttttattcaggatccaaatgtatatttaatagctttcagtagttgtatctcataagtctgtaacctacaggttccatttacctttgttttcttatttcttgaagttgctgagtcattttttaattagaatttgctgtattct

SEQ ID NO: 201563 - DNA, 2567 bp, Homo sapiens
  Payload ID: 19774
  Gene Name: zinc finger protein 154
  Uniprot ID: Q13106
  ENST ID: ENST00000451275
  CDS Start-End: 224-1537
ttttagcttctctgaggtgtgttcaccggatcagagatagcagagcgccgagttggggccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagcggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctagatgttcatcatcagaagcagcaccttggagaaaaacatttcagaagcaatgtgggcagagccttgtttgtgaagacctgcacattccatgtgtcaggggagccttccacctgcagagaagttgggaaggacttcctggccaagttgggatttctccatcaacaggctgctcacactggggagcaatcaaatagcaaaagcgacggtggggccatcagtcacagaggaaaaactcattacaactgtggagaacacacaaaagcattcagcggtaaacacacacttgttcagcagcagagaaccctcactacagaaagatgttacatatgcagtgaatgtgggaaatcctttagcaaaagctacagtctcaatgaccattggagacttcacactggagaaaagccttatgaatgtcgagagtgtgggaagtcctttaggcaaagctctagtctcattcagcaccggagagttcacactgcagtacgacctcatgaatgtgatgaatgtggaaaattatttagcaacaagtctaacctcattaaacatcggagagttcacactggggaaaggccatatgagtgcagtgaatgtgggaaatcctttagccaaaggtctgcactccttcaacatcggggagttcacactggggagaggccttatgagtgcagtgaatgtgggaagttttttacatatcattccagtctcataaaacaccagaaagttcacagtggatccaggccttatgagtgcagcgaatgtgggaagtcatttagccaaaactctagcctcattgaacaccatagggttcacactggagaaaggccttataagtgcagcgaatgtgggaaatcctttagccaaaggtctgcactccttcaacatcggggagttcacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaattccaggtatgtgtgaactgcattgcaccttttgccctgcccagggcccatgtcagatttatgtctctgctgatactatagtggaagccattttacctctactgcctggcaggtgaccaccagtgtgcaccactcacccatcccagtgtattcaggccatggacctgacccagtttggcccagaggactctgctggtgacctgaaaagagggactacatatttcaggatattgttggtctcacatgactcttgatagagtttgccagccttcaaatcaccaactgtgggaaccaactgcctcttattgccttgctgtgttcaattacaaaaaaagatggaaaagactgttatgaagccagatgaacctttctccagtcttccttcactatttttttttccttcaccatttatcatttcatagtcatttatgtttcatcggtcctcatgtgtactagtgcgttattttacttatactcccggatatcatattatttaatgcatagcctcttcagaatgcaattttaaaatgtaaaggctcttttataaccccccaaaaaatcacacaaatatattttaaaatgtaaatattttatcgcttctgttttctcagttgtctaaaacaatgtgtttcttaaggaagatcatttttattcaggatccaaatgtatatttaatagctttcagtagttgtatctcataagtctgtaacctacaggttccatttacctttgttttcttatttcttgaagttgctgagtcattttttaattagaatttgctgtattct

SEQ ID NO: 201564 - DNA, 2596 bp, Homo sapiens
  Payload ID: 19775
  Gene Name: zinc finger protein 155
  Uniprot ID: Q12901
  ENST ID: ENST00000270014
  CDS Start-End: 129-1745
ctccgagcaggacactgctacttaacaaggtggtttgagccaaactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 201565 - DNA, 2222 bp, Homo sapiens
  Payload ID: 19775
  Gene Name: zinc finger protein 155
  Uniprot ID: Q12901
  ENST ID: ENST00000407951
  CDS Start-End: 194-1843
acttccggtctccgagcaggacactgctacttaacaaggtggtttgagccaaactgtggcacgtttcaggcaggattcctccttcattcaaactgcatcacccaggagtctgcaaattccccaaagtaggaggaaaaatgaccacattcaagattaccaagactgtgggaatacttataacctgctcttggtcatgataaagagaagcaaagtacttgtattctgttcaaagattatggaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaac

SEQ ID NO: 201566 - DNA, 580 bp, Homo sapiens
  Payload ID: 19775
  Gene Name: zinc finger protein 155
  ENST ID: ENST00000590411
  CDS Start-End: 309-580
aggcacttgacttgatatgcatcagagggtccatatggcagagaaaccgtggaagtttggggagattgccatgtgcttcagttatgcctcaaagtcttcaacttcattggactgttcactttcaagggaaaccttagtaaggtgatatctgtgatagtcttctcaactacaagctcatctgagagttcacaatgggagaagcattaaaaatttgatacatgtgactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccaga

SEQ ID NO: 201567 - DNA, 1888 bp, Homo sapiens
  Payload ID: 19775
  Gene Name: zinc finger protein 155
  Uniprot ID: Q12901
  ENST ID: ENST00000590615
  CDS Start-End: 192-1808
ctgctacttaacaaggtggtttgagccaagtatgtgtcttgcgggtctttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgt

SEQ ID NO: 201568 - DNA, 559 bp, Homo sapiens
  Payload ID: 19775
  Gene Name: zinc finger protein 155
  ENST ID: ENST00000586454
  CDS Start-End: 214-559
tacttaacaaggtggtttgagccaagtatgtgtcttgcgggtctttgcgaaagtgaaccagttattaggggcgcctaacgacctggggggtcaactaagggggtaagaagccctggagaagacctgagactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcagg

SEQ ID NO: 201569 - DNA, 576 bp, Homo sapiens
  Payload ID: 19775
  Gene Name: zinc finger protein 155
  ENST ID: ENST00000591532
  CDS Start-End: 127-576
gacacttccggtctccgagcaggacactgctacttaacaagactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggt

SEQ ID NO: 201570 - DNA, 2732 bp, Homo sapiens
  Payload ID: 19775
  Gene Name: zinc finger protein 155
  Uniprot ID: Q12901
  ENST ID: ENST00000611002
  CDS Start-End: 265-1881
ccagacgcctgtggcatcatcgacacttccggtctccgagcaggacactgctacttaacaaggtggtttgagccaagtatgtgtcttgcgggtctttgcgaaagtgaaccagttattaggggcgcctaacgacctggggggtcaactaagggggtaagaagccctggagaagacctgagactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 201571 - DNA, 2318 bp, Homo sapiens
  Payload ID: 19776
  Gene Name: zinc finger protein 157
  Uniprot ID: P51786
  ENST ID: ENST00000377073
  CDS Start-End: 87-1607
agccttaccccttactggaggctgcaggaccctctacacacagacagctgtccagcacggaaggtgggctgaggcccagggtgaacatgccagctaatgggacatcaccccagagattccctgccctgattccaggagaacctggcagatcttttgaggggtccgtgtcattcgaggatgtggctgtggatttcacccgacaggagtggcacagactggaccctgctcagaggaccatgcacaaggatgtgatgctggagacctacagcaacctggcatctgtgggcctctgcgtggccaaaccagagatgatcttcaagttggagcgaggagaagagctgtggatattagaggaggaatcctcaggccatggttactcaggatctctctcactgctgtgtggcaatggttctgttggggataatgccctcaggcatgataatgaccttcttcaccatcagaagattcaaacattggatcaaaatgttgaatataatggatgcaggaaagccttccatgagaaaacaggctttgttagacgtaaaagaacacccagaggagataaaaactttgaatgtcatgaatgtgggaaagcttactgtaggaagtcaaaccttgttgaacatctgagaatacacacaggagagagaccctatgaatgcggtgaatgtgcaaaaaccttcagtgcaagatcatacctcattgctcatcagaaaactcacacaggggagaggccctttgaatgtaatgaatgtgggaaatcttttggcaggaagtcacaactcatcctacatacaagaacacacactggagagagaccctatgaatgtactgaatgtgggaaaaccttttctgagaaggcaaccctcacgattcatcagagaactcacacaggggagaaaccctatgaatgtagtgaatgtgggaaaacatttcgtgtaaagatatcccttacccaacaccacagaactcatacaggggagaaaccttatgaatgtggggagtgtgggaaaaacttccgtgcaaagaaatccctaaatcagcatcaaagaattcacacaggtgagaaaccctatgagtgtggtgaatgtgggaaattcttccgaatgaagatgactctcaataatcatcaaagaactcacacaggtgaaaagccctatcagtgtaatgaatgtgggaaatctttcagggtgcactcatctcttgggatccatcagagaattcacacaggagagaaaccttacgaatgtaatgagtgtggtaatgctttctatgtgaaagcacgcctaattgaacatcagaggatgcattcaggagagaaaccctacgaatgtagtgaatgtgggaaaatcttcagtatgaagaaatccctttgtcaacaccggagaactcacacaggagagaaaccttatgaatgtagtgaatgtggaaatgccttctatgtgaaagtacgcctcattgaacatcagcgaattcacacaggagagagaccctttgagtgtcaagaatgtgggaaagctttctgccggaaagcacacctcacagaacatcagagaactcacataggctggtcctggcgttgtacaatgaagaaagcctctcactgaagacttccctcaccattggatcaagctccttgggggcatatgatcaccagggcacacagtgtgcctgtgaaaatttggcacctacatttgtatcaaagtatgtcctgatccccttaggggatagctcattgtttttattcagatttccctaattagtggtgtgtgaacatcttatctgttgattggctatttgggttttttcttctgtgcattgactgttcatgtcctctgctcattgttttcaaatgggctgttcatctcttgctttttggtttaaatgttgttttttaacatatgagaatataaaaatcctttttttttcagtcatatgtgttgcaaatatcttctcccagactgtcgttggttttttaaattttgccatctgttttcttctgctgaagttttatattttatttatttattttttatttttttgagatggagtctcactctgtcacccaggctggagtgcaatggcatgacctcagctcatttcaaccttcgcctcccgggttcaagcgattctcctgcctcagtctcccaagtagctgggattacaggtgtgcaccaccatgcctggctaatttttgtatttttagtaaagacggggtttcaccatgttggccaggctggtctctaactcctgacctcaggtgatccacctgcctcggcctccaaaagtgttgggattacaggtgtgagccaccgtgc

SEQ ID NO: 201572 - DNA, 2616 bp, Homo sapiens
  Payload ID: 19777
  Gene Name: zinc finger protein 16
  Uniprot ID: P17020
  ENST ID: ENST00000276816
  CDS Start-End: 188-2236
aattcggggcgggacttccgggggtcagccggcgttggctgagacgtcttcgtgccacggtgctgcctcctttccaagcgcgacccgttgagatccccttgaccacaccctcattctcagctggtgctcatgaaggacagaagagtcaatgtcagtacaatgtgagtgaagggctgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggtaa

SEQ ID NO: 201573 - DNA, 2503 bp, Homo sapiens
  Payload ID: 19777
  Gene Name: zinc finger protein 16
  Uniprot ID: P17020
  ENST ID: ENST00000394909
  CDS Start-End: 102-2150
aattcggggcgggacttccgggggtcagccggcgttggctgagacgtcttcgtgccacggtgctgcctcctttccaagcgcgacccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagat

SEQ ID NO: 201574 - DNA, 575 bp, Homo sapiens
  Payload ID: 19777
  Gene Name: zinc finger protein 16
  ENST ID: ENST00000527811
  CDS Start-End: 204-575
agagcctctgggggctgcctccggtagggggtctccggggagaccccggggtaaggtcgccgcgaggggccgagccaggactccgcccacaggctggtggcgttcccgcctgtcggtgccaccattcgagctcgggcggagcgacggggtgaaggggtggcctgcccttccacacctgtgggatatctcatcaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcagg

SEQ ID NO: 201575 - DNA, 696 bp, Homo sapiens
  Payload ID: 19777
  Gene Name: zinc finger protein 16
  ENST ID: ENST00000532351
  CDS Start-End: 33-696
ctttccaagcgcgacccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatc

SEQ ID NO: 201576 - DNA, 2528 bp, Homo sapiens
  Payload ID: 19777
  Gene Name: zinc finger protein 16
  Uniprot ID: P17020
  ENST ID: ENST00000611477
  CDS Start-End: 102-2150
aattcggggcgggacttccgggggtcagccggcgttggctgagacgtcttcgtgccacggtgctgcctcctttccaagcgcgacccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggt

SEQ ID NO: 201577 - DNA, 1304 bp, Homo sapiens
  Payload ID: 19778
  Gene Name: zinc finger protein 160
  Uniprot ID: Q9HCG1
  ENST ID: ENST00000355147
  CDS Start-End: 410-853
gcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctgtcccccgcccacttcatccctcaggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagacctgctcaggagatggaaacattggctgctgctccttggcatctgctgccccaaacctcatggaagagtctccagccgtctccgcctgtcgaggtccctcggccatttcttccattctgcttttgccactttcatgggggtgtgtgataagcgagtgggttctatcttctaagattgttctcagcataaccgtaaagacacctaacaaaatccttctgtcattgatcctcagtcttacatggggtgcgtattctgtttttccaggcttcagcacagaaatacaagtactgcatgttgtcacttacatttggaatctaaaccaataaaactaatagcagcaaagagtagaatgtgggttaccacaggttggggactggagggaatagggagatgttggtcactgggtgaaaacattaggagtaaatgataggtttttgagatgacttatatggtaataggcttgtttccatcagtccatattgtatacctataacagaatatcagtttgtttcctgtaaatatatataactataatttgtcaatatagaatttttttaaaaatcatattccagttcttattgtgttggttctaaataaaaatgcttctttctcttaagacaaaa

SEQ ID NO: 201578 - DNA, 4336 bp, Homo sapiens
  Payload ID: 19778
  Gene Name: zinc finger protein 160
  Uniprot ID: Q9HCG1
  ENST ID: ENST00000429604
  CDS Start-End: 417-2873
gcagttgcccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctcta

SEQ ID NO: 201579 - DNA, 4219 bp, Homo sapiens
  Payload ID: 19778
  Gene Name: zinc finger protein 160
  Uniprot ID: Q9HCG1
  ENST ID: ENST00000418871
  CDS Start-End: 300-2756
gcagttgcccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctcta

SEQ ID NO: 201580 - DNA, 1926 bp, Homo sapiens
  Payload ID: 19778
  Gene Name: zinc finger protein 160
  ENST ID: ENST00000599247
  CDS Start-End: 259-1926
catcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcgg

SEQ ID NO: 201581 - DNA, 668 bp, Homo sapiens
  Payload ID: 19778
  Gene Name: zinc finger protein 160
  ENST ID: ENST00000601982
  CDS Start-End: 316-668
catcttagtggggagccactgttctcaattctgtgggaagggtcagtgcaagtcctgtagaaatgtattttgacatcattatgagatttaaacaaattcctcagtgaatgtttggttgtgatatgttaacctgcaagttttgaacattgacatgttttcgtgttaggaaacaggagctcacttttctacatccttgttggagcatgctgggaatgaagacaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaaggg

SEQ ID NO: 201582 - DNA, 4688 bp, Homo sapiens
  Payload ID: 19778
  Gene Name: zinc finger protein 160
  ENST ID: ENST00000601421
  CDS Start-End: 878-3226
atttgattccattctgacactgtctatctggatatagggtcagctcccataggctgagggctcaatcccacaacagcgcacacacattaatgccagtcacaaacacaagttgtggcctgtgcttctcaatgaccagctgtgaattgtgaattctgatgaccccctccttgaaattgattagtttgcttgagtggctcacataacacagggaaacacttatatttacccatttattatagaagatgctacaaagcacacagatgaacatctagatggaagtgatctattagttgagatatgggaaaggagtgaggagctgggatgtattctctcatgtattctgtcttttttgagttttcatggaggccccattatggaggccttgcttccattattggcattggtgatcaactgaactttcattccctctgtcctcccgagaggacagaggcttagtctaaccgagcctcagcctttccagtgaccacccaccgagccttagttccggtgaccgccctccatcctgaagctacctaggtgctccagacaccaattatcccattaatgtacaaaaagatacttatcactccactgatttcaagtgagctcttatgtcaggagagggggatgaagaccaaatctgtatgtcacattgtcacaatctggatctgtcagctcacccacttcaatttaacctattctcacatttttctcctcttctccttttatgtgaaattttgaactctccccttagccacttggtgaaatgtgtttttcattttaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctct

SEQ ID NO: 201583 - DNA, 4229 bp, Homo sapiens
  Payload ID: 19778
  Gene Name: zinc finger protein 160
  Uniprot ID: Q9HCG1
  ENST ID: ENST00000599056
  CDS Start-End: 302-2758
cctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctctatgaatgaa

SEQ ID NO: 201584 - DNA, 565 bp, Homo sapiens
  Payload ID: 19778
  Gene Name: zinc finger protein 160
  ENST ID: ENST00000599637
  CDS Start-End: 526-565
gcgcagttgcccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggtaggtctctcctccaaagctctggaaacagactcctgggagtgagagggaggggagcgcaggcaccgccccctttccccaagtcccccgcccacttcatccctcaggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtgg

SEQ ID NO: 201585 - DNA, 2107 bp, Homo sapiens
  Payload ID: 19779
  Gene Name: zinc finger protein 165
  Uniprot ID: P49910
  ENST ID: ENST00000377325
  CDS Start-End: 557-2014
gtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcttggtggcgtggggtgggggctgtcctactgatcctgaatttggggtcactggtaagaggagttgcccattccagccaggtggaacggggaggggtgccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgcccttgagaaacacaagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactgaaa

SEQ ID NO: 201586 - DNA, 2336 bp, Homo sapiens
  Payload ID: 19780
  Gene Name: zinc finger protein 169
  ENST ID: ENST00000340911
  CDS Start-End: 74-451
atcgtcgcctggtgcgtgatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccagctcagacaccaagttcttggctcttgcataaacagcaggccgaacaaatgtttctcaggcaaggtttaataggcttgagctggagcaaaagcaagggagcggcgcccaagaaaggaagataaatgtgtaactctacttgcagcaatttatagagctgaagctgcctgtgatgcttttttgaaccttttagtttggctgataggactagtttgtagtgtgggttttctgtgctgcaatagagcatgtaatgtgcccttgtgggttggaagataagtctttgttgtgaacatctgaagaaaactgctgggcaggtattacaatccatggtcacctgtggtgattctgaccaagactttctctctagcagagcctagaacagaattccagccaagttttccccacctggtggccttttctagctcgcagctcctcagacaatatgcgctaagtggccatcccacacagatcttcccaagctcatctgcaggaggtgacttccaactagaagctccaagatgctctagtgaaaaaggagaaagtggagagacagaaggccccgacagctcattaagaaagaggccaagcagaatttctaggacattcttcagcccacatcaaggtgacccagtagaatgggtagaagggaacagagaaggaggaacagaccttcgcctggcccaaaggatgagtcttggggggtcagacacaatgttgaagggagcagacacttcagaatctggagcagtcatacgtggaaactatagactgggacttagcaaaaagtcaagcctgttcagccaccagaagcatcatgtgtgccctgaatgcgggagaggcttttgccagagatcagaccttatcaagcaccagaggacacacaccggggagaagccatacctgtgtcctgagtgtgggcgtcggtttagccagaaggcctccctctccatacaccagaggaagcactcgggggagaagccgtatgtgtgcagggaatgtgggcgacacttcaggtatacatcctctctcactaatcacaagaggattcactccggggagaggccctttgtatgtcaggagtgtgggcgaggctttcgccagaagatagccctccttctacaccagaggacgcacttggaggagaagcccttcgtgtgtcctgagtgtgggagaggcttttgccagaaggcatcactcctccagcaccagagctcacacacaggggagaggcccttcctgtgccttgagtgtgggcgtagcttcaggcagcagtcactcctccttagtcaccaggtcacacactcaggagagaagccttatgtctgtgctgagtgtgggcacagctttcgccaaaaggtcactctcatcaggcaccagaggacacacacaggggagaagccttacctgtgcccccagtgtgggcggggttttagccagaaggtcaccctcattggacaccagaggacacacacaggggagaagccctacctgtgccctgattgtgggcgtggctttggtcagaaggtcaccctcatcagacaccagaggacacacacaggggagaagccttatctgtgccccaagtgtgggcgtgcatttggctttaagtcgctcctcacccgacaccagaggacacactcagaggaggagctttacgtagacagggtgtgtggacaaggacttggccagaagtcacaccttatctctgaccaaaggacacactcaggagagaagccctgcatttgcgatgaatgtgggcgcggctttggctttaagtctgccctcatccgacatcagcggacccattctggggagaagccgtatgtctgcagggagtgtgggcgtggctttagccagaagtctcacttgcatagacacaggaggaccaagtctggtcatcagctcctaccccaagaggtcttctgacctttcctttccccgtgagtgtgaagctggcagaaatcactagtaaatgcttcagtttcctgaaatggaatggaaaaaaaaaaa

SEQ ID NO: 201587 - DNA, 1986 bp, Homo sapiens
  Payload ID: 19780
  Gene Name: zinc finger protein 169
  Uniprot ID: Q14929
  ENST ID: ENST00000395395
  CDS Start-End: 91-1902
tacttccgcgttccggcatcgtcgcctggtgcgtgatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccagagcctagaacagaattccagccaagttttccccacctggtggccttttctagctcgcagctcctcagacaatatgcgctaagtggccatcccacacagatcttcccaagctcatctgcaggaggtgacttccaactagaagctccaagatgctctagtgaaaaaggagaaagtggagagacagaaggccccgacagctcattaagaaagaggccaagcagaatttctaggacattcttcagcccacatcaaggtgacccagtagaatgggtagaagggaacagagaaggaggaacagaccttcgcctggcccaaaggatgagtcttggggggtcagacacaatgttgaagggagcagacacttcagaatctggagcagtcatacgtggaaactatagactgggacttagcaaaaagtcaagcctgttcagccaccagaagcatcatgtgtgccctgaatgcgggagaggcttttgccagagatcagaccttatcaagcaccagaggacacacaccggggagaagccatacctgtgtcctgagtgtgggcgtcggtttagccagaaggcctccctctccatacaccagaggaagcactcgggggagaagccgtatgtgtgcagggaatgtgggcgacacttcaggtatacatcctctctcactaatcacaagaggattcactccggggagaggccctttgtatgtcaggagtgtgggcgaggctttcgccagaagatagccctccttctacaccagaggacgcacttggaggagaagcccttcgtgtgtcctgagtgtgggagaggcttttgccagaaggcatcactcctccagcaccagagctcacacacaggggagaggcccttcctgtgccttgagtgtgggcgtagcttcaggcagcagtcactcctccttagtcaccaggtcacacactcaggagagaagccttatgtctgtgctgagtgtgggcacagctttcgccaaaaggtcactctcatcaggcaccagaggacacacacaggggagaagccttacctgtgcccccagtgtgggcggggttttagccagaaggtcaccctcattggacaccagaggacacacacaggggagaagccctacctgtgccctgattgtgggcgtggctttggtcagaaggtcaccctcatcagacaccagaggacacacacaggggagaagccttatctgtgccccaagtgtgggcgtgcatttggctttaagtcgctcctcacccgacaccagaggacacactcagaggaggagctttacgtagacagggtgtgtggacaaggacttggccagaagtcacaccttatctctgaccaaaggacacactcaggagagaagccctgcatttgcgatgaatgtgggcgcggctttggctttaagtctgccctcatccgacatcagcggacccattctggggagaagccgtatgtctgcagggagtgtgggcgtggctttagccagaagtctcacttgcatagacacaggaggaccaagtctggtcatcagctcctaccccaagaggtcttctgacctttcctttccccgtgagtgtgaagctggcagaaatcactagtaaatgcttcagtttcctgaaatggaatggaaaaaaaaaaa

SEQ ID NO: 201588 - DNA, 1696 bp, Homo sapiens
  Payload ID: 19780
  Gene Name: zinc finger protein 169
  ENST ID: ENST00000481550
  CDS Start-End: 56-436
atttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccaggtgagtgggaagccctgggcaagcgagggtgcagggcagtgaggagctcagcaggtaaggaaggaggggctatctttgaggtgctaggaggaagttcttcttcaggcctcctaggccactggtaaaggctgcatggcactgcctgccttccacactgtgtgcctccccccaggacagggcacccctggcattccatctccttcctccatcagggagcctcactcctcacttggcttcctttctcgagcacattcaggatttctccattcttgggctcatgtggttggcatgatcttcaaaacagtacctgtcctttgagactaagtccctgcccctggttttttatttttatttttattttttttgagacagagtctcgttctgtcacccaggctggagtgcaatggcatgatctcggctcactgcaacctctgcctcctgtgttcaagtgatttctcctgcctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaa

SEQ ID NO: 201589 - DNA, 2716 bp, Homo sapiens
  Payload ID: 19780
  Gene Name: zinc finger protein 169
  ENST ID: ENST00000480716
  CDS Start-End: 56-391
atttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccagagtctcgttctgtcacccaggctggagtgcaatggcatgatctcggctcactgcaacctctgcctcctgtgttcaagtgatttctcctgcctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaagatatatacttaggtgtgtagtagctggttcacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttaggtctttaactggaattaattttatatgaatgctgggagatagaaataaatttttgcctgctttatcttcttacttgtttattttcatggtttcctggcattttatttttgttttattttttgcttttaaatgtaactatatagctggtattacactatgtagcaactgagtgcttttgtctttttaaaagcatttcgttatataaaaatggggtgggcacagtggctcacgcctgtaatcccagactttgagaggctgaggtgggtggatcacttgaggccaggagtttgagaccagcctggccaacatggcaaaatcccgtctctactaaaaatacacaaattagccgagcctggtggtgcatgcctgaaataccagctactcggatggctgaggagtgagaatcgcttgaacctgggaggcgaaggttgcaatgaactgagatcacaccactgtactccagcctgggctacagagtgagactctgtctcaaaaaaaaataaagtaaaataatgataaaaatgttattaagatacagcaattaaggtatattataagatatgttttttaaggtataataaactacacttatataggtgtgaaatttggttagttttggcatatgtatacatgcatgaaagcactgccacagctaaagtaacaagcatgtctgtcatccttgaaaattttctttcgccttactgtaatcctacctcccactccttcctgtcctcccctgtacctgggcaaccactgatcagctttctataattatagatttgtctgcattttctagaatttgtataactggattatacaggatacaactggattcttcactcagcataagtattttgaattttatctataatgtgtgtatcaatagtttattaatttttattgctgagtattcctttatatgtctaggtcacattttaatactgacctattaaaaggtatttgggttttcatttttgacaaatataaataaagctgttttaagcatgcaa

SEQ ID NO: 201590 - DNA, 2716 bp, Homo sapiens
  Payload ID: 19781
  Gene Name: zinc finger protein 17
  Uniprot ID: P17021
  ENST ID: ENST00000307658
  CDS Start-End: 264-2258
acgcctcctggggttgtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgagggttcatagcagtggcagcaatgcttatggatgctggacaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtactgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagttttggtcttcttgtggtttattttgtggcttattttgcttaacgttatatttttaaggtttcatgttctaatccattagaatttccatcctttttaaaggctgaataaaattctgttagtcatgtgttgcttaacagtg

SEQ ID NO: 201591 - DNA, 630 bp, Homo sapiens
  Payload ID: 19781
  Gene Name: zinc finger protein 17
  ENST ID: ENST00000595162
  CDS Start-End: 219-374
gggttgtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgaggtgggtgccgcgtcccagggcgccccgcccgatccctcctccgagtgccgaagccccgaggaggggccctgcaggtcaggcccctgtgtcccaaagagaggagcgttcttgtgtggggtaccggtgtccgcggtgctgtgaggcgggggagctcctgtcagggacctgcacgtgcgaggcttagaggtgctgcagagcgggcggcactggggagcccgagcgtctttgtctccacggagctgaggggttcatagcagtggcagcaatgcttatggatgctggacaggttgttggcatggagccaaggatgaggaggcaccttccaagcaatgtgtttctgtaggagtgtcacaggtcacaactttaaagccagctttgtccacccagaaggcccagc

SEQ ID NO: 201592 - DNA, 2524 bp, Homo sapiens
  Payload ID: 19781
  Gene Name: zinc finger protein 17
  Uniprot ID: P17021
  ENST ID: ENST00000601808
  CDS Start-End: 214-2202
gtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtactgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagtttt

SEQ ID NO: 201593 - DNA, 391 bp, Homo sapiens
  Payload ID: 19781
  Gene Name: zinc finger protein 17
  ENST ID: ENST00000597350
  CDS Start-End: 244-391
ccatataagccctattagttggcaatccttttaatctctattttacacataagggcaccgagacttaaggaagttcagtcctcatcaagacactgaaccctgaggacttactgtgtaccctcagataactttgctctagttgcagggccagaggtggttgtacagtcagcctgtaggatgctgcaatgctgtcttaatcctcatggcctgcctcttcccacagggttcatagcagtggcagcaatgcttatggatgctggacaggattatatggtttttgaggacgtggccatacatttctcccaggaggagtggggaattcttaatgacgttcagagacacctgcacagcgatgtgatgctggagaactttgcacttttgtcctcagtag

SEQ ID NO: 201594 - DNA, 2260 bp, Homo sapiens
  Payload ID: 19782
  Gene Name: zinc finger protein 174
  Uniprot ID: Q15697
  ENST ID: ENST00000268655
  CDS Start-End: 586-1809
ccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaatttcaa

SEQ ID NO: 201595 - DNA, 1557 bp, Homo sapiens
  Payload ID: 19782
  Gene Name: zinc finger protein 174
  Uniprot ID: Q15697
  ENST ID: ENST00000344823
  CDS Start-End: 762-1466
gtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtacttt

SEQ ID NO: 201596 - DNA, 1002 bp, Homo sapiens
  Payload ID: 19782
  Gene Name: zinc finger protein 174
  ENST ID: ENST00000572544
  CDS Start-End: 32-781
acaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgct

SEQ ID NO: 201597 - DNA, 1586 bp, Homo sapiens
  Payload ID: 19782
  Gene Name: zinc finger protein 174
  Uniprot ID: Q15697
  ENST ID: ENST00000571936
  CDS Start-End: 309-1532
gggtcctaagtccctcggtcttgggttcccggagagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctccc

SEQ ID NO: 201598 - DNA, 1068 bp, Homo sapiens
  Payload ID: 19782
  Gene Name: zinc finger protein 174
  Uniprot ID: Q15697
  ENST ID: ENST00000575752
  CDS Start-End: 309-1013
gggtcctaagtccctcggtcttgggttcccggagagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaacttcttatagaaaagacagatccaaatatggccacagatgaacttccatgcaagctatggctgagtttcattgcttaaaatgctcctctgtttagaggggcctggtagaaataaaaacccaccctatatctta

SEQ ID NO: 201599 - DNA, 6535 bp, Homo sapiens
  Payload ID: 19783
  Gene Name: zinc finger protein 175
  Uniprot ID: Q9Y473
  ENST ID: ENST00000262259
  CDS Start-End: 359-2494
gttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcagtgaatgtgggaaagcctttacccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaaaatcttctcagaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggacatgtattgtctgggcttcttttgtgctgcactggcagaattgagtagttttggcggagatcaaatagcccccaagctggaaactgaaaatatctactctctggctctttacagaaaatgtttgccagcacatgatacacacacaaacacacacacatacacacatattactatgttcatcatcatatacctgtgtaagtactctttcattgatttataaaactcagatctcttacgtgtgtggatggtatttttttcattctacaatccatgatggattgtacacacgtgtattctatgaggttgacctgccataatttatttagccattcccacagttttgattacttatttcctccccacacacattttttgctaaaaaacggagagggaactgttatcaatacttccgagaagcagaccagcataatcttttaagtgcacaggcccaggagccaggttcctgcatttgattcctggctccactctctaccctctgcatctgctgagcaagttatttggtctcatctattctggttttctcatctacaaaagggagatgatgatagtaccctacccccatgcatttggtgtgagaagtgtgtgtgtgttaaacccttggaactgcatggacagaccaagtgctgatgaattttagcgggcctcgtatccctgagcctgcctggttcccttgtgctgggtgtgggactgtggtgggagatttctgtcagctggaagtcttttccagaagggtgttagagatgggcacccatggctttagtctccataccccttcaaggttgataggggcccacacagctggtcaggaaccagcacagacctcaggctgtgtctaaaacaaggtgactgcacatgcaggagcctgtgctgggccctggagagcaaatctgttctgtgtctcactggcctctccctgtccaggggcgtagtatcagtgaccatgtcccacctcctgagaaaggtggaagagtctcacctggggagtccaggtacaagggctggccggccgtagatgactggtgtggggtggaaaggctgcagaggcctctccatggtggtgaggggtggaaatagtgtgcacctgggtcctgggagtggcaccctgaccagtttcagggaggaaggtggcagggccctaggacaagtgtgttaaaaacttgagcccacagtgtagacacactggttccaaagacccctcaggatgtgcctcccttctcagatctgggctttccctgttcctaagcatcacctggggggatcactctgggtcctcatctccagccacatgttcactcctcacgtgggcctccctaactgtccccctcagggcaagcccttcctccccacttccagaaagctgctcgttccctggccatcccacacctctgacctcgtgccacttccggggcctgttggctttaacaacttagtttcctccctacctcgcaaccccctctgtctagagtgctcacctccctcccagcctctgtctcatactattttttctttcctctcagtaccaagcgctgggacaagccagtctgtactcaatgcctgtgggataatagacggaggaatctggagtttggttgggtgattagctttggaattgatgggtcccagggagctatctaaagttttcagtcacatgagggcatgctcacagatctgtgaaaagatctgttggctcagagaactaagagatgaataaatgttagtccaatggcctcatcatgagatgagaggtcaagagttttgagtttccagagggagaagctactattctaggcagcttgtatgaactaactcgtttattcctcacagccattgtaggaaataatctaacctcataaaccccattttagagatgaggaaacaggcttagagaatttgacgtaaactcaagaccgaaaatctaggaacaagaaaagcctggatttgaaccaagctatctgatgccagtgttttaactctcaaccattgtactactttacctcctcatgaccttttttttttttttcttgtgagatggagtctcgctctgtcgcccaggctctggagtgcagtggcacgatctcagctcactgcaagctccgcctcccgggttcacgccattctcctgcctcagcctcccgagtagctgggactacaggcgcccaccaccatgcctggctaattttttgtatttttagtagagacggggtttcaccgtgttggccaggatggtctcgatctcctgacctcgtgatccccccccctcggcctcccaaagtgcccatgacctttttattgttgggcagtgaaagccatggtgaaatgaagaatgtcctactgtcatgtgatgtgatcagaaaacatactgcccagagtcccctgcccccacccccaaaaccagtacttgatccatcctttgactgttgtggcgattggcacaaaggttgggcacagtagtagttaggctcatgggctctggagccaacctacctggatgctacacatcccagctctgcccctcgctagtttggtggcaagcaacttaacctctctgccttaatttctccagcagcacaatgggaataataatagatctcgccttgtggctcctttgcagattacatgcgttaattatgtaaagtcaagcattagaatggtggctgtccaccatgagtacaacacaaatgctcgttcttaatgattcaacaaacatggaatttcattaaatctgaaataaaggtattttgagaaattg

SEQ ID NO: 201600 - DNA, 488 bp, Homo sapiens
  Payload ID: 19783
  Gene Name: zinc finger protein 175
  ENST ID: ENST00000436511
  CDS Start-End: 3-341
agatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttgga

SEQ ID NO: 201601 - DNA, 1239 bp, Homo sapiens
  Payload ID: 19783
  Gene Name: zinc finger protein 175
  ENST ID: ENST00000545217
  CDS Start-End: 359-514
gttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggtaaacaggggcagccctggggatagttctccagaacgtgagggcagacacaggatgcagcaggtctgggctccctgctcctgagtcagtcttgagcctcctgtcaagcgaggaccacagaggctgatgtttccacattcataggctatctgtgttctagaggaaaccatgaactggctgataaaagaggatagtagagggttggccttgggtcaagaaagaagaaactgtagtccctggtctgatcagaagccccagtcataggatggaaaagctgactctttcctgctaagcactggttctgctccttcatccaccactgggtctttgaaaaatttcaagtggtcccccccaccaaattccttgcttggtccatggggtttggcccgtttttcctctgttctcataaggtgcggcaaaatctccttcctttgtaatttaaatagtcacagggaggtagagtgagaagaggcttttaaggaccatgtgaagaggcttttaaacactttttcctgtttaaaaaggtgaacaaaaaatgctggaaaacagtgtttccagattgcccacagatagaaatagtcaggatttggtaacaagaaatcagaattcttggtatagtcaagatttcctgaaatcctaaattattctgtgtatctcttgatgctttatttacaagtctttaaatagtatgtgactataatagtaaacagtgtaccattgttctgtgatgggtttataaccaaatttacagagatgttctgttttttaaaaaaagtataataaatatgtgtgttattatcctgaaccaa

SEQ ID NO: 201602 - DNA, 580 bp, Homo sapiens
  Payload ID: 19783
  Gene Name: zinc finger protein 175
  ENST ID: ENST00000596504
  CDS Start-End: 353-565
aagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtgggtgagcacaactgacctgggaatcttggc

SEQ ID NO: 201603 - DNA, 1835 bp, Homo sapiens
  Payload ID: 19784
  Gene Name: zinc finger protein 177
  Uniprot ID: Q13360
  ENST ID: ENST00000343499
  CDS Start-End: 457-1422
cgccatctcccatagctgtcgcctgcagctgagaaagggttgctgtcccagcaggccaggtccagggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaa

SEQ ID NO: 201604 - DNA, 612 bp, Homo sapiens
  Payload ID: 19784
  Gene Name: zinc finger protein 177
  ENST ID: ENST00000590616
  CDS Start-End: 44-424
ttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttcaa

SEQ ID NO: 201605 - DNA, 560 bp, Homo sapiens
  Payload ID: 19784
  Gene Name: zinc finger protein 177
  ENST ID: ENST00000592912
  CDS Start-End: 510-560
atagctgtcgcctgcagctgagaaagggttgctgtcccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctgccattccgggcattggttcccgggaggagggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccag

SEQ ID NO: 201606 - DNA, 1920 bp, Homo sapiens
  Payload ID: 19784
  Gene Name: zinc finger protein 177
  Uniprot ID: Q13360
  ENST ID: ENST00000589262
  CDS Start-End: 67-1512
taattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttag

SEQ ID NO: 201607 - DNA, 2767 bp, Homo sapiens
  Payload ID: 19785
  Gene Name: zinc finger protein 18
  Uniprot ID: P17022
  ENST ID: ENST00000322748
  CDS Start-End: 606-2255
atctgcgtccgcacctgactcagctgggcaccccggagctacggaggggccagcgggctcccttgcccatgcgtctgggagcgcgcgggggacgtggcgaggctgaaaatgagtctctggaagaggaaacccgatgggatgatgcctggagtctctccctctctcatcagagtgcagtcggcatttggggggcgcatggtggagaatacatatccaatgagcagcgctgccctggcctcgagcactaaatgccagttcccctagctgcttgtgacaaccagaaaacgccccaacaaatcaccagacgttggcagttctccccaaagcaaaggctttagagcttcctgggttaatctggctgccacttgtgagcctcggaggttcctgatctgtacaccaggatggagtctccctctgtcgcccaggctggagtgcagtggtacgatcttgactcactgcaacttccgcctcccaggttcaggctgttctcctacctcagcctcctgagttgctgggattacagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggagcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttct

SEQ ID NO: 201608 - DNA, 2261 bp, Homo sapiens
  Payload ID: 19785
  Gene Name: zinc finger protein 18
  Uniprot ID: P17022
  ENST ID: ENST00000454073
  CDS Start-End: 110-1756
cgcccggagccggcgccgcgggccgagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtc

SEQ ID NO: 201609 - DNA, 2250 bp, Homo sapiens
  Payload ID: 19785
  Gene Name: zinc finger protein 18
  Uniprot ID: P17022
  ENST ID: ENST00000580613
  CDS Start-End: 89-1738
ttttagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggagcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttct

SEQ ID NO: 201610 - DNA, 698 bp, Homo sapiens
  Payload ID: 19785
  Gene Name: zinc finger protein 18
  ENST ID: ENST00000577671
  CDS Start-End: 1-698
cacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggaggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttc

SEQ ID NO: 201611 - DNA, 570 bp, Homo sapiens
  Payload ID: 19785
  Gene Name: zinc finger protein 18
  ENST ID: ENST00000580903
  CDS Start-End: 281-570
acccagctcccggaagtgcgcccggagccggcgccgcgggccgagtagagacggggtttcaccgtgttaaccaggatggtttcgatctcctgaccacgtgatccacctgcctcggcctcccaaagtgctgggattacaggcgtgagccaccatgcccagccttctcaccctctttaaccccaaggttgaaagtgtcagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagat

SEQ ID NO: 201612 - DNA, 729 bp, Homo sapiens
  Payload ID: 19785
  Gene Name: zinc finger protein 18
  ENST ID: ENST00000582607
  CDS Start-End: 1-729
tctgagccacatcgtgaaagaggaatctgacacagaagcagaactagccctggctgcctcccagcctgcccgactggaggaaaggctgatcagagaccaggacctcggagcctcactgctcccagcagcacctcagtggagacaactggattccactcaaaaggagcaatactgggatctcatgctggagacctatgggaaaatggtctcaggaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagct

SEQ ID NO: 201613 - DNA, 2330 bp, Homo sapiens
  Payload ID: 19785
  Gene Name: zinc finger protein 18
  Uniprot ID: P17022
  ENST ID: ENST00000580306
  CDS Start-End: 163-1812
acgtcgttcgcctgccgcctgaggcgcgcgcagccacccagctcccggaagtgcgcccggagccggcgccgcgggccgagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggagcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttctatctta

SEQ ID NO: 201614 - DNA, 4335 bp, Homo sapiens
  Payload ID: 19786
  Gene Name: zinc finger protein 180
  Uniprot ID: Q9UJW8
  ENST ID: ENST00000221327
  CDS Start-End: 283-2361
acaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcagtgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaatgaaatacaaagatttccttctttgactatttaggaaagactaagcaaccaaatagcaaagatccctcaggataatgaggtttatgtttggaatagcatgagcagattactacttaggacatagattcctaggaacattcctcattgaaaataaaatggattcctggaaataggtaactagaaattttggccagaaatggtttcatatgaagaactgagaatgcgtgggaagtatagagggcaagtgggcttattttcatatatgcaaagcaatattaaggaactctattttcatgttttagttcttcccctcatgtagcattgtctctttcctctgggatatgttccctgatgtgagagtcctctgaatagaagggtgcttccctggctcagtgctgaccgtctaaattatgcttgcaaaaatgctttcatgaggcaaagttttagttactctttgatatttaagatttgattaacatgtctttctgacctttcccttgaatcatgaatttgaatcctgtggatgaccatatattgaagcctctgatcccagaaaggtaataagctgaaagttgaactgagagaccagataatagaggttaatacccttgggataggaaagaaaacttaaagggtaactgatggggttatccttagcaaaattctatccctatgagatgaccctaagtggagccatctctatgaggattaatccagagattgttgcacacctggcagtgtcaggtctgggaaaacagttgctgatgttttcatggagtgtgaaatactgaaagctgcgggcatcccttggggaccactgacccacactttgaagaaccctcaatgagtctgaaagaggttcagtatctcttgggaaggatgtgttccaggctccaggcctagtcttacatggccagtggggttgaaagactgtgcccctgcaatggtcttttcctaagacagttgaacaaagttccaagtctgtctgtcctattttaaccatctttaagaagcacaaaggggatatgagaaaaacagatgctgaaatgaaaattttaactgatatcttacttatctcacaagtcgtgtaaagaaagaaatgatatggtcgaatattagattagatggtttaatgatgttttgagtgttatatatgagctatgatgagacctagaaaataaagtaaaaataaaaaatatataagccatgaa

SEQ ID NO: 201615 - DNA, 3049 bp, Homo sapiens
  Payload ID: 19786
  Gene Name: zinc finger protein 180
  ENST ID: ENST00000391956
  CDS Start-End: 281-2284
aagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgctcaggacctcagcaccctgctgtgcctggaggagagcatggaagagcaggatgagaagcccccagagcccccgaaggtctgtgcacaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcagtgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaatg

SEQ ID NO: 201616 - DNA, 525 bp, Homo sapiens
  Payload ID: 19786
  Gene Name: zinc finger protein 180
  ENST ID: ENST00000587047
  CDS Start-End: 271-468
attgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgtgcagctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcagacttggcaactgcagttggaaaaaaagattcaacttcaaagca

SEQ ID NO: 201617 - DNA, 3270 bp, Homo sapiens
  Payload ID: 19786
  Gene Name: zinc finger protein 180
  ENST ID: ENST00000592095
  CDS Start-End: 265-417
gacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccagtgcagctcaggacctcagcaccctgctgtgcctggaggagagcatggaagagcaggatgagaagcccccagagcccccgaaggtctgtgcacagagtcttgctctgtcgtccaggttggagtgcagtgacacaatcctagctcactgccgcctcaaacttctgggctcaagccatcctcctgcctcagccgcctgaataggtgggactacaggaattttggcaggtcccgctggacagttcttagcgtcttagtgctccttagtgtcttggatcactcagtcagctgcatttagctgcaatgggctggcccagaagacccaaaaagacctcatgtccaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcagtgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaa

SEQ ID NO: 201618 - DNA, 1023 bp, Homo sapiens
  Payload ID: 19786
  Gene Name: zinc finger protein 180
  ENST ID: ENST00000586637
  CDS Start-End: 305-721
acaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccagtgcagctcaggacctcagcaccctgctgtgcctggaggagagcatggaagagcaggatgagaagcccccagagcccccgaaggtctgtgcacagatggagtcttgctctgttgcctaggctggagtacagtggcatgatcttggatcactgcaacctccacctcctgtgttcaagtgattctcctgcctcagcctcccaagtagctgggactacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatg

SEQ ID NO: 201619 - DNA, 837 bp, Homo sapiens
  Payload ID: 19786
  Gene Name: zinc finger protein 180
  ENST ID: ENST00000591064
  CDS Start-End: 287-837
acaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccagctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttat

SEQ ID NO: 201620 - DNA, 3048 bp, Homo sapiens
  Payload ID: 19786
  Gene Name: zinc finger protein 180
  ENST ID: ENST00000592529
  CDS Start-End: 293-2290
cacaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccagtgcagctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcagtgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagcc

SEQ ID NO: 201621 - DNA, 3131 bp, Homo sapiens
  Payload ID: 19786
  Gene Name: zinc finger protein 180
  ENST ID: ENST00000590088
  CDS Start-End: 285-482
ccacaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgtgcagctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcagtgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaa

SEQ ID NO: 201622 - DNA, 2791 bp, Homo sapiens
  Payload ID: 19787
  Gene Name: zinc finger protein 181
  ENST ID: ENST00000392232
  CDS Start-End: 169-2016
cggttcgttgcgcctggaattttgtcccctgcgcggatgattctgggaaatgtcgatcggctgtgggcggcgcactgggtccgccccgctgtagcctcaggacactgcccatctctaagataagagcctggaaagaggactctgttggctgttggaaattgcagagtaatgcctcagcttcagtacccagagggttacctggcaccaaatagatgcttagtaagtaattgtggagtgaataagatgagtaatgacgaactggtggggcagaatcatggcatggaaggtgaagcttgcataggaggggatgtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtgaatataggaagaccttttagcaaagatgcaggccagtttgtttattagactttatactgtagagaaatcatatgaagaccataaatgtgggaaagcctttgtcagtattaatcccttaattgacataagtatactcacactaggataaaaccctgtacatgtagcaaatgtgggaaagactacagacaataggaatcttttacaaactcctacaggagagaagctgtatgaatgtagaaaatttagaaattgagggaagtcttcagttccaagtatatcccttattctacagcagagaactcaaaatggagagaaatctcatttaagagatgtagcaaagtgttcactaagagtgtttatcttggtacacatcagaagattaatggtagaacaacctgaaggatttaggagttatgtgtaaatctttgcagtcatgctatttgtaaactggattctacaggagagcaaataaacattataataaaatatgcatttcttagagcagtagcttgcagtttcagttgagttctacttagaaattctttttagctagtgggcatgtgaagatatttagtcacccagaggagccagtaagtgttataatattgaaaattaaagctgcaaaagaaataaagtgatgttaataaaagttttggcatctaataaaatcattttgtatatcacaaa

SEQ ID NO: 201623 - DNA, 2265 bp, Homo sapiens
  Payload ID: 19787
  Gene Name: zinc finger protein 181
  Uniprot ID: Q2M3W8
  ENST ID: ENST00000459757
  CDS Start-End: 464-2176
ctttgggttatgtcgtcatgaagccggcgctctacagttgtgtaaccttgaacaaatgggttcagtatcttggaatttcagttttgtcatcgtttaaaaaatagatctggaaaaatgtgaacgcacaccgtgcatagtggtgaagactgaacgagctgataaagtttttaccattgttttatgaggattttatttacagagtaattgattttcctcgcaggtggcacctggtaaatggttagcccttgcggagaaacaccctgttagttcccagggagagattggcgccctggagagtgattaccagtgtgcctttccattatggtgtgtcacaggtgccgcaagataagcctgatttttcatgactgctttttcctgcccttctgtgccctcaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtga

SEQ ID NO: 201624 - DNA, 5086 bp, Homo sapiens
  Payload ID: 19787
  Gene Name: zinc finger protein 181
  Uniprot ID: Q2M3W8
  ENST ID: ENST00000492450
  CDS Start-End: 90-1805
cctgcccttctgtgccctcaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtgaatataggaagaccttttagcaaagatgcaggccagtttgtttattagactttatactgtagagaaatcatatgaagaccataaatgtgggaaagcctttgtcagtattaatcccttaattgacataagtatactcacactaggataaaaccctgtacatgtagcaaatgtgggaaagactacagacaataggaatcttttacaaactcctacaggagagaagctgtatgaatgtagaaaatttagaaattgagggaagtcttcagttccaagtatatcccttattctacagcagagaactcaaaatggagagaaatctcatttaagagatgtagcaaagtgttcactaagagtgtttatcttggtacacatcagaagattaatggtagaacaacctgaaggatttaggagttatgtgtaaatctttgcagtcatgctatttgtaaactggattctacaggagagcaaataaacattataataaaatatgcatttcttagagcagtagcttgcagtttcagttgagttctacttagaaattctttttagctagtgggcatgtgaagatatttagtcacccagaggagccagtaagtgttataatattgaaaattaaagctgcaaaagaaataaagtgatgttaataaaagttttggcatctaataaaatcattttgtatatcacaaactctttcactgtgactatttcctgtaaaaaaaatttcactaagattagccttagcgtagcctttagtgggagactagcaaacctagagaaaaatgacctgctctttatactaagaatagcagtattttgatgaggattattcagagtcaatttccagtaggcttaatcaaatacatttcaaaaaaatttactgagcatcactcgtgtattattacacagcgatgggatataggaatccagtagttctgagctttagtggtgtgtcaaagtcagtaggagggcttgttaaagcacagattgctaagtctgaatcttagggtttctgtatgagttgatttgaatttgcatttttcatgcgttcttaggcgacacactgtccagaaagcacattttgataaccattgtaataatgaacaaaacaaatctgatctttttctcgcagggatgttatctgacaagaaagatggatagcaaataaatttgaaataatggtttacaagtgctatgaggacataaccaagaaacaacatactacaagagatcagagcaggcttagcgagatgtgatttttgaaatgaatcctaaatgatgaacactaattatgtaatgagtactactcatgtagccatgtgcatccctgcatgtgcctgtgcgtgtgtgtatgcggtgtgctgggtgttaatctaggtaaagcagacagtcgagttctgtcatacttgctgcagctggattccacgttcccatgtctagtttcagattctgtggctttgaggtagtgctgctggcagcatcattgcagcaaccgtcatttctctatccctgagtcatagttacgggagtttaccttgaaatcactagcccagaagtgttctcattacttttacagcccacctaccaattttgaaagcactaatttgcagcaatatatgtcttgaaatagttaagagagattttgttctctgcactgaaccttgacagataattatgttttgtaaggaggcaggatggcttcaaatattctaagttctagataagaaatggaacagtctcactggccctgtgattagaatcctatcttgtgattagaaaggtaatgcagatcaatttgatttggagtgtatggacactgatgcaagtgaaggggtgtgatatggattatgcttcagattttgttctttatctcaggtgagagtagtaagatatgttattttaaaaaggaacattatgttatagttatgataattctggtgtggaatgagtgataaggtttctgactttcaacaaaatgtatctcctctgatatatgtgctaccttaacagaaagccaaagcacagaggcatattccaatagcaatttgcaagagacagtaggtttggaatggggtggtaaacttttactattttgcagggattttatctttcatttgatttatttttaatcatgaaatttatattgaaattctgtgaaacattgaaggatctttggaagatttataattagggaagggccagatgtagtggctaatgtctgtactcccagcactttgggagaccgaggcaggaggattgcttgaggccaggagtttgagaccagcctgggcaatatagcaaaactcattagtctgttaaaaaaaaaaattacccaggtgtaggcacacatctgcagtcctagctattcaggaggctgagtggggagggattgcttgagtacaggagttttaaggtcacagtgagctatcatcacaccactgctttccagcctggacagcagaacaccaccctgtctccaaagtaaataaatacaattaaggaagcatgatgtggtatcagacagttgcaagtatggatagactggctaccacatatatacttatgggataatgagagtagctttcttttctctcattctgtgtcctttctctgctctcccaagcaactggtaccacagagatgaagtagtcctataatgcccagattttgtttccactacacatagtttaatgctaccatgtcactttgttatgagaggattcatcgaaatacctgtgctttgtcatttaaaaagcatgggcatacacatgataatgctttacgtttctggatttaaagtgccttcacaatacagaactaggaaaaagaaggccatctttttaaatgaagatagttttaagagagcaataagagactattactttgttatgatagaaggttgggctgatgtcataatgatgttatgatgtcactgacatcatattatttcctcagtcatacctattaaccatttcttgagcatccactatgggcttaatagataagaaacactccataccctttaagagccctgaggtgtgtgtgtgtgaacagcattaaactttggagtcatgttacctgggtttaaatccaagttgcatgaatactggctttgtgtgaccttggacaaactatttcactgtgtcttgcctcagtttctccatctgtaaaatgataataaagctatctcacagca

SEQ ID NO: 201625 - DNA, 498 bp, Homo sapiens
  Payload ID: 19787
  Gene Name: zinc finger protein 181
  ENST ID: ENST00000593781
  CDS Start-End: 167-498
ggcgactcccaggctccgggacgattctgggcagtgtcgtccccagaggtcggcggccgttgcccgctcaccagcgacgcggggcgcctgcggggacggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaagattgggaatcaagatgggaaaacaaggaattatcaacaaagaaggataattatgatgaagattcaccccaaacagtaataatagaaaaagttgtaaaacaaagttatgaattttc

SEQ ID NO: 201626 - DNA, 499 bp, Homo sapiens
  Payload ID: 19787
  Gene Name: zinc finger protein 181
  ENST ID: ENST00000599244
  CDS Start-End: 275-499
gcggttcgttgcgcctggaattttgtcccctgcgcggatgattctgggaaatgtcgatcggctgtgggcggcgcactgggtccgccccgctgtagcctcaggcctgacggcgactcccaggctccgggacgattctgggcagtgtcgtccccagaggtcggcggccgttgcccgctcaccagcgacgcggggcgcctgcggggacggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtaggtctttctgtaactaagccatatgtgatcacgttattggaggatggaaaagagccctggatgatggagaaaaaactgtcaaaaggtatgattcca

SEQ ID NO: 201627 - DNA, 567 bp, Homo sapiens
  Payload ID: 19787
  Gene Name: zinc finger protein 181
  ENST ID: ENST00000595708
  CDS Start-End: 134-567
gtagcctcaggcctgacggcgactcccaggctccgggacgattctgggcagtgtcgtccccagaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctag

SEQ ID NO: 201628 - DNA, 3235 bp, Homo sapiens
  Payload ID: 19788
  Gene Name: zinc finger protein 182
  Uniprot ID: P17025
  ENST ID: ENST00000305127
  CDS Start-End: 1-1920
atgacaccagcatctgcatctggtgaggactcaggaagcttctactcatggcagaaggcaaagagggaacaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagct

SEQ ID NO: 201629 - DNA, 3465 bp, Homo sapiens
  Payload ID: 19788
  Gene Name: zinc finger protein 182
  Uniprot ID: P17025
  ENST ID: ENST00000376943
  CDS Start-End: 287-2149
gtaacggtctcctgagcagcgagcagaaaatctgttatcgagagagacacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagcta

SEQ ID NO: 201630 - DNA, 3586 bp, Homo sapiens
  Payload ID: 19788
  Gene Name: zinc finger protein 182
  Uniprot ID: P17025
  ENST ID: ENST00000396965
  CDS Start-End: 352-2271
agtgcttgttggggccaggctttgtaacggtctcctgagcagcgagcagaaaatctgttatcgagagagagtgagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccagtcctgcaagctgtacaagaagcatgacaccagcatctgcatctggtgaggactcaggaagcttctactcatggcagaaggcaaagagggaacaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagct

SEQ ID NO: 201631 - DNA, 3101 bp, Homo sapiens
  Payload ID: 19789
  Gene Name: zinc finger protein 184
  Uniprot ID: Q99676
  ENST ID: ENST00000211936
  CDS Start-End: 286-2541
gttgaagccggttgtaggcgtggaaagaggttggcgcgctggaagtccagttgcttcggctccctgcgttaggtctggtggcggtcaatgcgcttccggacccgggatcagagtgtgtggatcgctatagggggaggggagctcagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggatttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaataccctcaaattaacaattcaattgcatataatagcctaactcagtaagaatattaaaacttactattattcttcttct

SEQ ID NO: 201632 - DNA, 2899 bp, Homo sapiens
  Payload ID: 19789
  Gene Name: zinc finger protein 184
  Uniprot ID: Q99676
  ENST ID: ENST00000377419
  CDS Start-End: 161-2416
tgcacagagggaacacaccagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggatttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaata

SEQ ID NO: 201633 - DNA, 4148 bp, Homo sapiens
  Payload ID: 19790
  Gene Name: zinc finger protein 185 (LIM domain)
  Uniprot ID: O15231
  ENST ID: ENST00000318504
  CDS Start-End: 49-1941
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 201634 - DNA, 3878 bp, Homo sapiens
  Payload ID: 19790
  Gene Name: zinc finger protein 185 (LIM domain)
  Uniprot ID: O15231
  ENST ID: ENST00000318529
  CDS Start-End: 265-1671
gttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggagcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 201635 - DNA, 3597 bp, Homo sapiens
  Payload ID: 19790
  Gene Name: zinc finger protein 185 (LIM domain)
  Uniprot ID: O15231
  ENST ID: ENST00000324823
  CDS Start-End: 41-1399
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 201636 - DNA, 4305 bp, Homo sapiens
  Payload ID: 19790
  Gene Name: zinc finger protein 185 (LIM domain)
  Uniprot ID: O15231
  ENST ID: ENST00000370268
  CDS Start-End: 38-2107
ctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 201637 - DNA, 2166 bp, Homo sapiens
  Payload ID: 19790
  Gene Name: zinc finger protein 185 (LIM domain)
  Uniprot ID: O15231
  ENST ID: ENST00000370270
  CDS Start-End: 1-2166
atgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctag

SEQ ID NO: 201638 - DNA, 2120 bp, Homo sapiens
  Payload ID: 19790
  Gene Name: zinc finger protein 185 (LIM domain)
  ENST ID: ENST00000436731
  CDS Start-End: 1-1659
atgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccaggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctag

SEQ ID NO: 201639 - DNA, 3191 bp, Homo sapiens
  Payload ID: 19790
  Gene Name: zinc finger protein 185 (LIM domain)
  Uniprot ID: O15231
  ENST ID: ENST00000454925
  CDS Start-End: 9-992
aaagtgaaatggccgcccgggacgagctcggcctcggcggggattctcttgaggccatgcccgtgccggccgccagaggtcgcccgaggatcacgaatgggcccgaggagctggctgccccttcccccgcggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatca

SEQ ID NO: 201640 - DNA, 4328 bp, Homo sapiens
  Payload ID: 19790
  Gene Name: zinc finger protein 185 (LIM domain)
  Uniprot ID: O15231
  ENST ID: ENST00000449285
  CDS Start-End: 49-2121
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 201641 - DNA, 554 bp, Homo sapiens
  Payload ID: 19790
  Gene Name: zinc finger protein 185 (LIM domain)
  ENST ID: ENST00000447792
  CDS Start-End: 1-554
cagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcaggtcttccccaggcaacaaagacaaggaggccccctgctccagagagctccagagggacttggctggtgaggaggctttcagggcccccaacacagatgctgcaagctccagtgccacttcagtctctgctgtccctgctgataggaagagcaacagcacagcagcccaggaggatgcaaaggcagacccaaagggcgtgttgactgattttgaggggaaggatgtggccaccaaggtcggagaggcctggcaggacaggcctggagccccaagaggtggccaaggagacccagctgtacccactcagcaacctgcagatcccagtaccccagaacagc

SEQ ID NO: 201642 - DNA, 3545 bp, Homo sapiens
  Payload ID: 19790
  Gene Name: zinc finger protein 185 (LIM domain)
  ENST ID: ENST00000426821
  CDS Start-End: 1-1345
tctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcac

SEQ ID NO: 201643 - DNA, 4421 bp, Homo sapiens
  Payload ID: 19790
  Gene Name: zinc finger protein 185 (LIM domain)
  Uniprot ID: O15231
  ENST ID: ENST00000535861
  CDS Start-End: 49-2214
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 201644 - DNA, 4334 bp, Homo sapiens
  Payload ID: 19790
  Gene Name: zinc finger protein 185 (LIM domain)
  Uniprot ID: O15231
  ENST ID: ENST00000539731
  CDS Start-End: 49-2127
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 201645 - DNA, 3115 bp, Homo sapiens
  Payload ID: 19791
  Gene Name: zinc finger protein 189
  Uniprot ID: O75820
  ENST ID: ENST00000259395
  CDS Start-End: 350-2104
gcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaagagagacttgataaatcggcctgagaaaataagtaatgctccagactagctctctcatttgtgagttctccaggtgaagcaccatttttgaccttcccttgtgtcttctgttcctggcacagtgcctggaccccaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttg

SEQ ID NO: 201646 - DNA, 3021 bp, Homo sapiens
  Payload ID: 19791
  Gene Name: zinc finger protein 189
  Uniprot ID: O75820
  ENST ID: ENST00000339664
  CDS Start-End: 130-2010
gcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggggttgctgacatttgaggatgtggctgtgttttttacccaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttg

SEQ ID NO: 201647 - DNA, 3134 bp, Homo sapiens
  Payload ID: 19791
  Gene Name: zinc finger protein 189
  Uniprot ID: O75820
  ENST ID: ENST00000374861
  CDS Start-End: 285-2123
aaggaggaggaactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttg

SEQ ID NO: 201648 - DNA, 2316 bp, Homo sapiens
  Payload ID: 19791
  Gene Name: zinc finger protein 189
  ENST ID: ENST00000615466
  CDS Start-End: 69-326
taggcctcaccagaggctcctttccgtgaggccgcccccaattcctgcccctattctctgcctgggagatggcttccccgagccccccgccggagtcgaaggaggagtgggattatctggacccagctcagagaagcctgtataaagatgtcatgatggagaattatggaaacctggtctcactgggtctcactctattgcctaggctggtgtgcagcgacgcaaacacagcttgctgcagcctcaacctgttgggcttaagtgatcaatcctcccacctcagctacctgagtagctgggactacagatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaa

SEQ ID NO: 201649 - DNA, 3220 bp, Homo sapiens
  Payload ID: 19792
  Gene Name: zinc finger protein 19
  Uniprot ID: P17023
  ENST ID: ENST00000288177
  CDS Start-End: 257-1633
acttccggcctcctaaccgttctcgctagcggtgcgcttctggcctgttttgagtccgcgctcaaaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgagttaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctccctacccaattccagacttaattgcttactgcgtctagcacctgggtggcttcaccacctcttccttacttgtcagcagatgaatgagcagttgtatcatgtgcttgggttgaccaatgaatgatagacttggggaattgagtaaacaccttttaattgaagtataacacaaacataaaaatgcatgagtcagccaggcgcggtggctcacacttgtaatcccagtactttgggaggccgaggtgggcgattcatcaggtcaagagatcgagaccatcctggccaacatggtgaaaccccgtctctactaaaaatacaagaattagctgggcgtggtggtgcatgcctgtagtcccagctgctcaggaagctggggcaggcgaattgcttgaacccgggaggcggaggttgtagtgagccgagattacaccactgcactccagcctggtgacagagtgagattcctcaataaaataaaataaaaccatgaa

SEQ ID NO: 201650 - DNA, 567 bp, Homo sapiens
  Payload ID: 19792
  Gene Name: zinc finger protein 19
  ENST ID: ENST00000565541
  CDS Start-End: 111-302
tttcctcagaattacaaacctcatggtatgatgtggattaaaaagtacatatttatgcaccactaacccagtgagcatttacctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttgggaagaagtcacaaatgctcagtttcctgttgatcggaatctctttggccttctccagtcgagaaccctcttctggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgac

SEQ ID NO: 201651 - DNA, 587 bp, Homo sapiens
  Payload ID: 19792
  Gene Name: zinc finger protein 19
  ENST ID: ENST00000566202
  CDS Start-End: 519-587
aactggagagtatcaggactgggtgctaccaagcgcctcacagcagcccccagccgacaccaacatcccaaccctgggcgacccgcggctgcgcaggcgcggatgcatgtttagggggctgcgctagtcagtgcgcatgcgccgtcgctaggcaacaggacacagctccgggcgccggcgtagaatctgagctgcaggaaggaggagaagaaatgtggtcggaagatgaggaatgaggtggtccataaagtgaggtaggtgattataaattacatgtgaagtaaacttccctagcgtgtgggtctctgtatttaacctctgccttccaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttc

SEQ ID NO: 201652 - DNA, 2612 bp, Homo sapiens
  Payload ID: 19792
  Gene Name: zinc finger protein 19
  ENST ID: ENST00000565637
  CDS Start-End: 571-1821
gctagcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgagttaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagcttt

SEQ ID NO: 201653 - DNA, 532 bp, Homo sapiens
  Payload ID: 19792
  Gene Name: zinc finger protein 19
  ENST ID: ENST00000564225
  CDS Start-End: 314-532
aggaaggaggagaagaaatgtggtcggaagatgaggaatgaggtggtccataaagtgagagaaacacagtgaagtactgacagtagaaatgatatgatgtctgagttcaactccagcaaaacaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttgg

SEQ ID NO: 201654 - DNA, 573 bp, Homo sapiens
  Payload ID: 19792
  Gene Name: zinc finger protein 19
  ENST ID: ENST00000568815
  CDS Start-End: 221-573
cttagaggtgatacattggctgggaagacaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatgg

SEQ ID NO: 201655 - DNA, 1947 bp, Homo sapiens
  Payload ID: 19792
  Gene Name: zinc finger protein 19
  ENST ID: ENST00000569717
  CDS Start-End: 55-192
cgcaccgctttctgtttttcctgagcctttgcctgctaagagggagaccaggtcatggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggc

SEQ ID NO: 201656 - DNA, 615 bp, Homo sapiens
  Payload ID: 19792
  Gene Name: zinc finger protein 19
  ENST ID: ENST00000569072
  CDS Start-End: 601-615
acaagcgtgacgcacttccggcctcctaaccgttctcgctagcggtgcgcttctggcctgttttgagtccgcgctcaaaggctgtacaggaggcatggctggggaggcctcaggatacttacaatcatggtggaaagcaaaggggaagcaggcacaatcttcacatggccagcaggagagagacagcaaaggaggaagcgcaacacacttcgaaacaaccagatcacatgagaactcactatcacgagaacagcaagggggaaatccgcccccatgatccaatcaccttccaccatgttcctcccccaacactgaagatcataattcaacatgagatttgcctggggacacagagccaaaacatatcaagtatacatttccttagaggtgatacattggctgggaagacaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcct

SEQ ID NO: 201657 - DNA, 2205 bp, Homo sapiens
  Payload ID: 19792
  Gene Name: zinc finger protein 19
  Uniprot ID: P17023
  ENST ID: ENST00000564230
  CDS Start-End: 469-1845
caaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatac

SEQ ID NO: 201658 - DNA, 577 bp, Homo sapiens
  Payload ID: 19792
  Gene Name: zinc finger protein 19
  ENST ID: ENST00000561469
  CDS Start-End: 1-243
gtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaaggtaggtgaggcagatttagaaccaacaattgtagcgttttatggagcactgtattttaaaatgaatcatgctgggcaggatttaaataaaatagatgatttcacctaataggtaaaatatgaaacgtttctcaccaatcttaactcttaccaacatgtaatcactcagtacgtctcatctgcaatccttgaatccattgttcctttctgagtttcaacattgcctaccttagttgtcctccttggttgggatggatttattcaggagcagtttttgagcaacttgccatgtgctgaacgttgtttaagaagttctggcaggtacaagttatggagacagatg

SEQ ID NO: 201659 - DNA, 2838 bp, Homo sapiens
  Payload ID: 19792
  Gene Name: zinc finger protein 19
  ENST ID: ENST00000567225
  CDS Start-End: 23-325
ctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgaatcattggaatttcagaaaagctaagtggttgtccaaggtctcatagctagtaggtgaagaaatcaggacttctcagtcctgtacatttatttttaattttcttttctctgtgtttgtttttgaatagtttctgttgctatgtcttcaaattcactcatcttttttctgtaatgtctaatctgccgttaatcccatccaatgtatttttattgcacattataggtttttatctttagaagtttgatttgggtcttttttatatgtttcatttctccaccaaacttttagatgtatcagatatggttgtaataacttttaaatgtcattgcctactaattctgttgtgactatttcagaagtctatcaggattagtttttaatgtaatttcttggattatgaattactggtccaagtagatagtattaatttaaactctatacttaatgatgcaaactatgattataaatttttagaagacatttctactaccacttcaaagcttaggcaaggaccataagattctttgttatctctctttgttcatgagatttttaaaaaatttatcctttcatgattggatgagtgtatgtgtgtgagaaaagtctctgttcctattccttgttcctgtaatatgcctcctgcatattataattctgctttctcagatatcaagacttacaactcttcaccattcccacccctgttggccaaagcatcagctgaggtcctcagtccaaaccaatgcctctggttttagtttcttgtttggttttggtacgtgggtacactttcctgtgagttaagtatttaaaatgatgtcgaatattatatcttattctaaatttctagattctagtttatattatttgctacattgccctcaactgaattctgcgtaatatttattgtcttaaacttattgttgtgagatattaatatagctgtgccattttccctttcccttaatacttgtctgatatatctattttccattctttgactttcaatacttgtgctttcttaagtttcagtagtaccttataagcatctaacattttctttccttccttccttcctttctttctctttctttctctttctctctctctttctttctttctctctccttctctctctctttttttttttgacggagtctcattctgtcacccaggctggagtgcagtggcatgatcttggctcactacaacctccgcctctcgggttcaagcaattctcctgccccagcttccccagtagctgggattacaggtgtgcgccaccacgctgggctaatttttgtatttttagtaaagacaaggtttcaccatgttggccaggctggtcttgaactcctgagctcaggtgatctgtccacgttggcctctcaaagtgctgggattataggcatgaggcactgtccagtcacttctaacattttttctgcgtaaattttagaatcattttcacaagttttaaaacaaatcctataggggttttatttggtatgacgttggacttatggattaaataaagaaaactacccttcctactgaaggattacctgtgcctttccatttacacaaggggttttcattggtttagtccccaaatgtttaaaattttcttgatatatgtcttatacatttattagtaaacttattcctatatatgtttggttgctttgagaataagaccttgccctaccctagtacatttctccacatagattaaatgatttattcacagaactcacaacatcaataagtaggtaaaaattttgtagcctgaaaacagccttgaactcctggaatgaacatcaaccagacagttgttttgccacagttttcatgagaagaagcaggcaaagccatctttactctgtcctattaaaactggaaacaacaagaaatattttttcttttttgagacggagtttcgctcttgtcgcccaggctggagtgcaatggcgctatctcagcccaccacaacttccgcctcctgggttcaggcgattctctggcctcagcctcccgagtagctgggaatacaggcatgcgccaccacgcctggctaattttgtatttttagtagagacagagtttctccacgttagtcaggctggtctcgaactcccaacctcaggtaactccccccacctcagcctgccaaagtgctgggattccaggtgtgagccaccacgcctggccaacaaaaaagattttttttaacatgagaagattgtcagctttccctggtggtcagagaggaagggctttagagaggtcttggggctgcagggacaaagggtgcaggagaagaagccttagagctgagcaggaggaaactgacactacatggctgcaggcccagcatggaaatgaacttctagaatgctgtagtcgaagagccagcttaattttttaactcttgtgttgtgtgatttttccatccttcctcatttctaggggtattagttaggctatgggcttggaaattaatttgaagaacccaaataaatgtggtttaaatttga

SEQ ID NO: 201660 - DNA, 2087 bp, Homo sapiens
  Payload ID: 19792
  Gene Name: zinc finger protein 19
  ENST ID: ENST00000565100
  CDS Start-End: 135-1301
accgctttctgtttttcctgagcctttgcctgctaagagggagaccaggtcatggcagccatgcctctgaaagctcaataccagggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgagttaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaa

SEQ ID NO: 201661 - DNA, 2021 bp, Homo sapiens
  Payload ID: 19793
  Gene Name: zinc finger protein 195
  Uniprot ID: O14628
  ENST ID: ENST00000005082
  CDS Start-End: 77-1897
gctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatg

SEQ ID NO: 201662 - DNA, 3145 bp, Homo sapiens
  Payload ID: 19793
  Gene Name: zinc finger protein 195
  Uniprot ID: O14628
  ENST ID: ENST00000343338
  CDS Start-End: 270-1955
gtccaatcaggcacatgtctggagaggagaggacggcttccgggatctagcggggcctttgtcccgacagagctccacttcctgtccccgcggctctgtgtcccctgctagccgtaggtcgtgtgacccgcaggcaccgggagatccagaagtgaaacgccaggctctctggaggccaggagatggcatattctcacgatgcaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatgggaaaaataagcaaggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagaggctctttgtggttgttttatatacttgtaagtgatttatgagataggtgtttagaataatactcttctgttagggtcaccctgatcagaccgttcccttcccctcccacaggacttacaatacggtcccttgtgctctctgcacagctaccccagggcaaaaaacaaaccccccttcactgatccctccagtaactgtgcagacagttacaggatgcggttaacatgtctgttcacctcgcataacaaagctggcaaaaaacatctccaggatgcagacaagacacctgcaccctcgactaagctcccccaccccaacccagttctcctgcacccccaactcagctcccgcaccccgacctagttctggccctataaaaacctgctatagtctgtaagcagggctgcctcctctaactgtggtggagcagccaagcagctcaataaagcttgcttgcctg

SEQ ID NO: 201663 - DNA, 2970 bp, Homo sapiens
  Payload ID: 19793
  Gene Name: zinc finger protein 195
  Uniprot ID: O14628
  ENST ID: ENST00000354599
  CDS Start-End: 106-1779
cttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatgggaaaaataagcaaggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagaggctctttgtggttgttttatatacttgtaagtgatttatgagataggtgtttagaataatactcttctgttagggtcaccctgatcagaccgttcccttcccctcccacaggacttacaatacggtcccttgtgctctctgcacagctaccccagggcaaaaaacaaaccccccttcactgatccctccagtaactgtgcagacagttacaggatgcggttaacatgtctgttcacctcgcataacaaagctggcaaaaaacatctccaggatgcagacaagacacctgcaccctcgactaagctcccccaccccaacccagttctcctgcacccccaactcagctcccgcaccccgacctagttctggccctataaaaacctgctatagtctgtaagcagggctgcctcctctaactgtggtggagcagccaagcagctcaataaagcttgcttgcctga

SEQ ID NO: 201664 - DNA, 2369 bp, Homo sapiens
  Payload ID: 19793
  Gene Name: zinc finger protein 195
  Uniprot ID: O14628
  ENST ID: ENST00000399602
  CDS Start-End: 128-2017
cctttgtcccgacagagctccacttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgcactgtgctcacctggggtgctgcaaactgtgaaatggtttttagagttcagatgcatcttctcactagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatgggaaaaataagcaa

SEQ ID NO: 201665 - DNA, 2389 bp, Homo sapiens
  Payload ID: 19793
  Gene Name: zinc finger protein 195
  Uniprot ID: O14628
  ENST ID: ENST00000429541
  CDS Start-End: 531-2216
aatcaggcacatgtctggagaggagaggacggcttccgggatctagcggggcctttgtcccgacagagctccacttcctgtccccgcggctctgtgtcccctgctagccgtaggtcgtgtgacccgcaggcaccgggagatccagaagtgaaacgccaggctctctggaggccaggagatggcacagacaccttaccagaatgtctttggtttgaggttccactttggaaacttgacagggtgatttgctctcagccaccctctggactttttcctcagtttcagtattgtccagggataacacaggatgcccaccatggccatgtctgctggagcatctagtgaatttcaggccctgggttatttctcagaggacagcctgaggtatgaagtgtggcctctccagggagcagctggatgccctgggctgagagaaatctcctggtctactcttcctctaaagaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgt

SEQ ID NO: 201666 - DNA, 560 bp, Homo sapiens
  Payload ID: 19793
  Gene Name: zinc finger protein 195
  ENST ID: ENST00000427810
  CDS Start-End: 202-560
gtgacccgcaggcaccgggagatccagaagtgaaacgccaggctctctggaggccaggagatgtttcagtattgtccagggataacacaggatgcccaccatggccatgtctgctggagcatctagtgaatttcaggccctgggttatttctcagaggacagcctgaggtatgaagtgtggcctctccagggagcagctggatgccctgggctgagagaaatctcctggtctactcttcctctaaagagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaa

SEQ ID NO: 201667 - DNA, 1018 bp, Homo sapiens
  Payload ID: 19793
  Gene Name: zinc finger protein 195
  Uniprot ID: O14628
  ENST ID: ENST00000438262
  CDS Start-End: 155-427
tgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggtattttctttgtggttaccatggaaattatataaaacatcttaaagttacaacaagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaac

SEQ ID NO: 201668 - DNA, 1001 bp, Homo sapiens
  Payload ID: 19793
  Gene Name: zinc finger protein 195
  ENST ID: ENST00000528410
  CDS Start-End: 168-1001
gtccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagcactgtgctcacctggggtgctgcaaactgtgaaatggtttttagagttcagatgcatcttctcactagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccgga

SEQ ID NO: 201669 - DNA, 610 bp, Homo sapiens
  Payload ID: 19793
  Gene Name: zinc finger protein 195
  ENST ID: ENST00000526501
  CDS Start-End: 63-305
gtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagcatccgcaaacgtttagcttgtctttatatcttgacaattgtgaataatgctgcagtgaacatgagggagcagataattcttcaagatgctgcttttattcccttcagttattatatacacagaagtgtgattgctgcgttgcagggaccaagtgttgaagagactatactgtctgtattgtatcttcttcgtgaacttgtgaaagattaagtttcactctatcacccaggctgtagtgcagtggtgccatctcagctcactgcaacctctgcttcctgggctcgagccttcttcccacttcagcctcctgaggacctggaa

SEQ ID NO: 201670 - DNA, 881 bp, Homo sapiens
  Payload ID: 19793
  Gene Name: zinc finger protein 195
  ENST ID: ENST00000528796
  CDS Start-End: 94-333
gcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggtcaacatggctgaacaggagcctcgttctctgtcagaatcgccctacttgccctacctcatggctggcccttccggaccattgatgggctgccagccaccccctccacctccgtgtcctctgggacctcaaccactctctgcaactgaaggttttctgggacctctgatacatcctccactcgaacatcctctgggacctgaaacaccttctccagctgaagttttactgagaactcagatacctcctccactcaagtttcctaatggacctcagcaatgtcctccactcgagtgtcccctggaacttcaatcatctcctccactctagtgtcctctgggacttcaactacctactgcacttgagtgtcctctgggacctcaaccacctccactcaagtgtcctctgggacctcaaccacctcctccagttgagtgtcctctgggacctcaaccacctcctccagttgagtgtcctctggaacctcaacaaccttcttattaaagtttcctctgggacctcaaccacctcctgcactcaagtgccctctgggacctcatca

SEQ ID NO: 201671 - DNA, 764 bp, Homo sapiens
  Payload ID: 19793
  Gene Name: zinc finger protein 195
  ENST ID: ENST00000533036
  CDS Start-End: 113-764
agctccacttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggctggaagtgcagtggtgtgatcgtggctcactgcggcctccacttcccaggttcagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatg

SEQ ID NO: 201672 - DNA, 546 bp, Homo sapiens
  Payload ID: 19793
  Gene Name: zinc finger protein 195
  ENST ID: ENST00000525502
  CDS Start-End: 107-546
acttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagtttcactctatcacccaggctgtagtgcagtggtgccatctcagctcactgcaacctctgcttcctgggctcgagccttcttcccacttcagcctcctgaggacctggaactacaggggcacaccgccacacccagctaacttttgtgtttttaatagagacagggttttgccatgttgcccaggctggtctcggactcctgggctcaagtg

SEQ ID NO: 201673 - DNA, 558 bp, Homo sapiens
  Payload ID: 19793
  Gene Name: zinc finger protein 195
  ENST ID: ENST00000529228
  CDS Start-End: 1-159
ggtctcactgtctgtaagccaggcctgatcacctgcctggagcaacgaaaagagccctggaatgtgaagagacaggaggcagcagacggacatccaggttgtactttttttgagacagggatttattctgtcactcaggctggaagtgcagtggtgtgatcgtggctcactgcggcctccacttcccaggttcagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataata

SEQ ID NO: 201674 - DNA, 579 bp, Homo sapiens
  Payload ID: 19793
  Gene Name: zinc finger protein 195
  ENST ID: ENST00000529678
  CDS Start-End: 187-579
gtccccgcggctctgtgtcccctgctagccgtaggtcgtgtgacccgcaggcaccgggagatccagaagtgaaacgccaggctctctggaggccaggagatggcatattctcacgatgcaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaa

SEQ ID NO: 201675 - DNA, 575 bp, Homo sapiens
  Payload ID: 19793
  Gene Name: zinc finger protein 195
  ENST ID: ENST00000530643
  CDS Start-End: 91-333
gctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagcatccgcaaacgtttagcttgtctttatatcttgacaattgtgaataatgctgcagtgaacatgagggagcagataattcttcaagatgctgcttttattcccttcagttattatatacacagaagtgtgattgctgcgttgcagggtattttctttgtggttaccatggaaattatataaaacatcttaaagttacaacaaggttgtactttttttgagacagggatttattctgtcactcaggctggaagtgcagtg

SEQ ID NO: 201676 - DNA, 519 bp, Homo sapiens
  Payload ID: 19793
  Gene Name: zinc finger protein 195
  ENST ID: ENST00000532539
  CDS Start-End: 247-519
aatcaggcacatgtctggagaggagaggacggcttccgggatctagcggggcctttgtcccgacagagctccacttcctgtccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggaccaagtgttgaagagactatactgtctgtattg

SEQ ID NO: 201677 - DNA, 720 bp, Homo sapiens
  Payload ID: 19793
  Gene Name: zinc finger protein 195
  ENST ID: ENST00000525313
  CDS Start-End: 70-309
gtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggtgggtgggaatgaacgaagcaggtaacccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaa

SEQ ID NO: 201678 - DNA, 2008 bp, Homo sapiens
  Payload ID: 19793
  Gene Name: zinc finger protein 195
  Uniprot ID: O14628
  ENST ID: ENST00000526601
  CDS Start-End: 175-2007
acttcctgtccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgag

SEQ ID NO: 201679 - DNA, 891 bp, Homo sapiens
  Payload ID: 19793
  Gene Name: zinc finger protein 195
  Uniprot ID: O14628
  ENST ID: ENST00000528218
  CDS Start-End: 167-439
tccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggtattttctttgtggttaccatggaaattatataaaacatcttaaagttacaacaagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaa

SEQ ID NO: 201680 - DNA, 682 bp, Homo sapiens
  Payload ID: 19793
  Gene Name: zinc finger protein 195
  ENST ID: ENST00000534569
  CDS Start-End: 338-682
gtcccctgctagccgtaggtcgtgtgacccgcaggcaccgggagatccagaagtgaaacgccaggctctctggaggccaggagatgtttcagtattgtccagggataacacaggatgcccaccatggccatgtctgctggagcatctagtgaatttcaggccctgggttatttctcagaggacagcctgaggtatgaagtgtggcctctccagggagcagctggatgccctgggctgagagaaatctcctggtctactcttcctctaaagaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgt

SEQ ID NO: 201681 - DNA, 3342 bp, Homo sapiens
  Payload ID: 19793
  Gene Name: zinc finger protein 195
  ENST ID: ENST00000620374
  CDS Start-End: 251-2152
gtccaatcaggcacatgtctggagaggagaggacggcttccgggatctagcggggcctttgtcccgacagagctccacttcctgtccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgcactgtgctcacctggggtgctgcaaactgtgaaatggtttttagagttcagatgcatcttctcactagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatgggaaaaataagcaaggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagaggctctttgtggttgttttatatacttgtaagtgatttatgagataggtgtttagaataatactcttctgttagggtcaccctgatcagaccgttcccttcccctcccacaggacttacaatacggtcccttgtgctctctgcacagctaccccagggcaaaaaacaaaccccccttcactgatccctccagtaactgtgcagacagttacaggatgcggttaacatgtctgttcacctcgcataacaaagctggcaaaaaacatctccaggatgcagacaagacacctgcaccctcgactaagctcccccaccccaacccagttctcctgcacccccaactcagctcccgcaccccgacctagttctggccctataaaaacctgctatagtctgtaagcagggctgcctcctctaactgtggtggagcagccaagcagctcaataaagcttgcttgcctg

SEQ ID NO: 201682 - DNA, 440 bp, Homo sapiens
  Payload ID: 19793
  Gene Name: zinc finger protein 195
  Uniprot ID: O14628
  ENST ID: ENST00000618467
  CDS Start-End: 168-440
gtccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccaggtattttctttgtggttaccatggaaattatataa

SEQ ID NO: 201683 - DNA, 2320 bp, Homo sapiens
  Payload ID: 19794
  Gene Name: zinc finger protein 197
  ENST ID: ENST00000334075
  CDS Start-End: 131-652
ggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagtctggcttctgttcccaccgttgtgtacagtctcctctgggagaggtcaccagtgccatgagtggggctcgagggcagctccattgttctcaatgcaaagctttactgctgttttgatgctccatacttgaggttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatccataacaactcaaataaatttcaagggaattaatgctgagtgaaaataatcacaaaaggccatattctgtatgaaaatattcatataacattctcaaaatgataaaactatagagatgaaaaatggattaatggtt

SEQ ID NO: 201684 - DNA, 3275 bp, Homo sapiens
  Payload ID: 19794
  Gene Name: zinc finger protein 197
  Uniprot ID: O14709
  ENST ID: ENST00000344387
  CDS Start-End: 186-3275
attctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctag

SEQ ID NO: 201685 - DNA, 1989 bp, Homo sapiens
  Payload ID: 19794
  Gene Name: zinc finger protein 197
  Uniprot ID: O14709
  ENST ID: ENST00000383744
  CDS Start-End: 207-1010
agtattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatg

SEQ ID NO: 201686 - DNA, 2935 bp, Homo sapiens
  Payload ID: 19794
  Gene Name: zinc finger protein 197
  Uniprot ID: O14709
  ENST ID: ENST00000383745
  CDS Start-End: 186-989
ctcggctgccggaagggctcgttcctgtgtcatctcctagcggcctggcgccgaggcggcggtacgcaaggctggagccgcagcgggagcccccggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatccataacaactcaaataaatttcaagggaattaatgctgagtgaaaataatcacaaaaggccatattctgtatgaaaatattcatataacattctcaaaatgataaaactatagagatgaaaaatggattaatggttgccaaaggttagggatggtgggaggaaaaatggggagagggttggatggaactattaaaaggtagcaccagaaaggtctttgtggtgatggaacacttgtgtatcttgattgcagtggtggttacacaaatctataggtgctatacctatacacacatactgtaccaatgttgatttcctttttcattttatgtaagatgtaaccatgaggggaaagtgggtgaagggtgctatctttgcaacttcctgtgattctatcatttcaaaataaaaagtaaaaaccaacaatggcaacgaaaacccaaaactaaagagctgtaaccaactaaagtgtgtgaaactgatttgaaaaaaagttataaaatacatgttttaggacagttgggaaatttgaatatgactggttattagatggtattagggaatttttgttgattttcttacctgtgacggtggtggtagtttgaagaatattcttaatcttaagggatgcatgttgaagtatttggaatgaagtgttctgatgtttacaactttcaaaaaaatgattttaaatatgtattgagagatcaggcaaacatagcaaaatgttcattgttgagtccacatggaaaatacgggtattcaatgtgccatactttcaactcttctgtactctgatattttcaaaataaaacatttgaggggaaatta

SEQ ID NO: 201687 - DNA, 4299 bp, Homo sapiens
  Payload ID: 19794
  Gene Name: zinc finger protein 197
  Uniprot ID: O14709
  ENST ID: ENST00000396058
  CDS Start-End: 168-3257
ggagctgactgggagctgactggggcctggaaagctcagttgtttctctgggctaactttaacaatgatttcttgaggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtcactgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaa

SEQ ID NO: 201688 - DNA, 546 bp, Homo sapiens
  Payload ID: 19794
  Gene Name: zinc finger protein 197
  ENST ID: ENST00000412641
  CDS Start-End: 311-546
acagagatgtggaaacctcacgaagcctagaagggccggagggacaggctgggagttagctgggagttgctgacgcagttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatggatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggc

SEQ ID NO: 201689 - DNA, 3275 bp, Homo sapiens; identical to SEQ ID NO: 201684
  Payload ID: 19794
  Gene Name: zinc finger protein 197
  Uniprot ID: O14709
  ENST ID: ENST00000628172
  CDS Start-End: 186-3275

SEQ ID NO: 201690 - DNA, 2320 bp, Homo sapiens; identical to SEQ ID NO: 201683
  Payload ID: 19794
  Gene Name: zinc finger protein 197
  ENST ID: ENST00000627858
  CDS Start-End: 131-652

SEQ ID NO: 201691 - DNA, 4299 bp, Homo sapiens; identical to SEQ ID NO: 201687
  Payload ID: 19794
  Gene Name: zinc finger protein 197
  Uniprot ID: O14709
  ENST ID: ENST00000627845
  CDS Start-End: 168-3257

SEQ ID NO: 201692 - DNA, 2935 bp, Homo sapiens; identical to SEQ ID NO: 201686
  Payload ID: 19794
  Gene Name: zinc finger protein 197
  Uniprot ID: O14709
  ENST ID: ENST00000627752
  CDS Start-End: 186-989

SEQ ID NO: 201693 - DNA, 546 bp, Homo sapiens; identical to SEQ ID NO: 201688
  Payload ID: 19794
  Gene Name: zinc finger protein 197
  ENST ID: ENST00000627004
  CDS Start-End: 311-546

SEQ ID NO: 201694 - DNA, 1989 bp, Homo sapiens; identical to SEQ ID NO: 201685
  Payload ID: 19794
  Gene Name: zinc finger protein 197
  Uniprot ID: O14709
  ENST ID: ENST00000627517
  CDS Start-End: 207-1010

SEQ ID NO: 201695 - DNA, 3737 bp, Homo sapiens
  Payload ID: 19795
  Gene Name: zinc finger protein 2
  ENST ID: ENST00000611463
  CDS Start-End: 489-1526
tcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggaatcagtgacattcgaagacgttgccgtggttttcacagatgaagagtggagtcgtctggtccccatacagagggacctctacaaggaggtgatgctggagaactataacagcattgtgtcattggactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcgatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtgaatgacttttctacttaccaaattctctccattcagaacacctcttggatttgcatactttctctgaattcacagcccagcctatacttttatcatccccagctcccactcctggcagcagtagctttctaattccagttcttcctgctttattgaagagggatgtgctaagctgtggtacagtaacaagcccgcagagagctatgtctcccttaaaacctgacgggaaccattctgtcttattctatcctcattatttggaacatctggcttccaaagtcaccacaagggcggaagagaaagctagaggaatttgtaggatattttcttagacccaggcttacatcacttctgtccacatctaataagccagaacccagcacctagaagctaggaaagtaaacaagcacctcgaaagttggttaataccaagaacctctctcacagttatattttgcatactactgttaagccagtctttgcaaatgaccccttcctgcccatcactgccttcctcaagacctaaaatagctccctatttagtgaaaaattatctgaatatttaaggtctgccttaacgtgatccccattgctgaattttacctcctgactccaaaaactcttctcttccctgggcccagtcctatttttttttttttttttttttttgtgagacagagtctcactctgtcacccaggttggaatgcaatggcacaatctccgctcactgcaagctccgcctcccgggttcacgccattctcctgcctcagcctcccgaatagctgggactacaggtgcccgccaacacgcccggctaattttttgtatttttagtagagacggggtttcaccgtgttagccaggatggtctcaatctcctgacctcgtgatccgcccgcctcggcctcccaaagtgctgggattacagacgtaagtcaccgtgcccggcctatatttttattttattaaaggttaggcactagatgaccttgactctaggcatctgcattctcttgatctttgcttagggtgaagctcagaaaaggacttggttctgaaaggctgtctggaattagattgtcctacgtgattcccagtgaattgagatgaatttcctctggaagttcaagtcggattcgagaagctgaattaccaaacagaccctccccaacctactaacgaccctattactctgttcaccctagagcagacgaacggcagggaagacttgatctgtggacttttgaaagcaacttgaggaaaaacacataacagaatctataggtgtggacaatatgtgatattgctaaataatgtcaagtaggaaataaaagagactattgacaaa

SEQ ID NO: 201696 - DNA, 3885 bp, Homo sapiens
  Payload ID: 19795
  Gene Name: zinc finger protein 2
  ENST ID: ENST00000617923
  CDS Start-End: 523-1674
tctcccaacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcgatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtgaatgacttttctacttaccaaattctctccattcagaacacctcttggatttgcatactttctctgaattcacagcccagcctatacttttatcatccccagctcccactcctggcagcagtagctttctaattccagttcttcctgctttattgaagagggatgtgctaagctgtggtacagtaacaagcccgcagagagctatgtctcccttaaaacctgacgggaaccattctgtcttattctatcctcattatttggaacatctggcttccaaagtcaccacaagggcggaagagaaagctagaggaatttgtaggatattttcttagacccaggcttacatcacttctgtccacatctaataagccagaacccagcacctagaagctaggaaagtaaacaagcacctcgaaagttggttaataccaagaacctctctcacagttatattttgcatactactgttaagccagtctttgcaaatgaccccttcctgcccatcactgccttcctcaagacctaaaatagctccctatttagtgaaaaattatctgaatatttaaggtctgccttaacgtgatccccattgctgaattttacctcctgactccaaaaactcttctcttccctgggcccagtcctatttttttttttttttttttttttgtgagacagagtctcactctgtcacccaggttggaatgcaatggcacaatctccgctcactgcaagctccgcctcccgggttcacgccattctcctgcctcagcctcccgaatagctgggactacaggtgcccgccaacacgcccggctaattttttgtatttttagtagagacggggtttcaccgtgttagccaggatggtctcaatctcctgacctcgtgatccgcccgcctcggcctcccaaagtgctgggattacagacgtaagtcaccgtgcccggcctatatttttattttattaaaggttaggcactagatgaccttgactctaggcatctgcattctcttgatctttgcttagggtgaagctcagaaaaggacttggttctgaaaggctgtctggaattagattgtcctacgtgattcccagtgaattgagatgaatttcctctggaagttcaagtcggattcgagaagctgaattaccaaacagaccctccccaacctactaacgaccctattactctgttcaccctagagcagacgaacggcagggaagacttgatctgtggacttttgaaagcaacttgaggaaaaacacataacagaatctataggtgtggacaatatgtgatattgctaaataatgtcaagtaggaaataaaagagactattgacaaa

SEQ ID NO: 201697 - DNA, 2601 bp, Homo sapiens
  Payload ID: 19795
  Gene Name: zinc finger protein 2
  Uniprot ID: Q9BSG1
  ENST ID: ENST00000614034
  CDS Start-End: 463-1740
aacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcgatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtg

SEQ ID NO: 201698 - DNA, 1465 bp, Homo sapiens
  Payload ID: 19795
  Gene Name: zinc finger protein 2
  ENST ID: ENST00000611147
  CDS Start-End: 84-1400
gaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagcccaggaaaaaaactgcatctgttttctgtttgttccagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtctt

SEQ ID NO: 201699 - DNA, 1624 bp, Homo sapiens
  Payload ID: 19795
  Gene Name: zinc finger protein 2
  ENST ID: ENST00000622059
  CDS Start-End: 112-1275
gtgcgcaggcgcgttggtttcccgacctgaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattggactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagca

SEQ ID NO: 201700 - DNA, 3061 bp, Homo sapiens
  Payload ID: 19796
  Gene Name: zinc finger protein 20
  Uniprot ID: P17024
  ENST ID: ENST00000334213
  CDS Start-End: 226-1824
agaagcgccggggcggagcccggccaacggtccgtccggaaggaggaggcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaatactcactgatgcccaactcttctatagattgagttggtttaagaggtctactttgtattgcaagcattgttgtttctacggattagcgagcctgttcttgattaaaccaactagatgggagcttgttcctctgctgcattgtgcagtgattggtctcaccaagggcttttatgtgagaagagccaccttgctcttatcaggaaatttcaagcatttgctgttattcacaactgaatgtaatgtctcacttcgtttttaactttgtatgagtatacctgactaaaaacactaatgcggtttcttggcaacaaatacttctgttcatgtattttagaaataagcttattaactgtttataacaactgcatactaacaattattattttttaatgaagaagctacattacaacctcccattaacatcatgtattagatcaagttgataatgttaccatgttatccggtggtcactgtgagtcagtgttgccatgtggatgtcaggcatatttttcctcatgtagattttacttttcatgcttatattcttagtttttatctggatcatgaattttcatctattctaaataccaaaggtgatctcatgttcttatgagtgacttctgaccaaagaccaccagtggcataagtgtcgtcaaagagggtgtaataatatactgtggtaatgaatatgaccaaaagccatagatgactgtgagatgtgtgagatattaaaagatagtcacatttcgtgagaagagaaaaa

SEQ ID NO: 201701 - DNA, 642 bp, Homo sapiens
  Payload ID: 19796
  Gene Name: zinc finger protein 20
  ENST ID: ENST00000418866
  CDS Start-End: 134-642
ggataccagatttcctactccgagaggccccgggtccctctgccacaacttctgtcgctctgccgcctgcaccgtgacccgcactattcacgggagccctagagaggacaccgggacacccagaagccgggaaatggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatgg

SEQ ID NO: 201702 - DNA, 669 bp, Homo sapiens
  Payload ID: 19796
  Gene Name: zinc finger protein 20
  ENST ID: ENST00000454949
  CDS Start-End: 145-267
ggttgttgtcgggataccagatttcctactccgagaggccccgggtccctctgccacaacttctgtcgctctgccgcctgcaccgtgacccgcactattcacgggagccctagagaggacaccgggacacccagaagccgggaaatggtaaccatctgtccctgttccttctggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaac

SEQ ID NO: 201703 - DNA, 560 bp, Homo sapiens
  Payload ID: 19796
  Gene Name: zinc finger protein 20
  ENST ID: ENST00000600335
  CDS Start-End: 160-555
ttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagacggagttttactcttgttgcccaggctggagtgcaacggcgggatctcggctcaccgcaacctccgcctccagggttcaagcgattctcctgcctcagtctcccgagtagctgggattacaagcacgcgccaccacgccaggctaattttgtatttttagtagagacggggtttctccatgttaggttggtctcgaactcctgacctca

SEQ ID NO: 201704 - DNA, 3082 bp, Homo sapiens
  Payload ID: 19797
  Gene Name: zinc finger protein 200
  Uniprot ID: P98182
  ENST ID: ENST00000396868
  CDS Start-End: 331-1515
gcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 201705 - DNA, 2373 bp, Homo sapiens
  Payload ID: 19797
  Gene Name: zinc finger protein 200
  Uniprot ID: P98182
  ENST ID: ENST00000396870
  CDS Start-End: 633-1817
acttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgagggcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttg

SEQ ID NO: 201706 - DNA, 3162 bp, Homo sapiens
  Payload ID: 19797
  Gene Name: zinc finger protein 200
  Uniprot ID: P98182
  ENST ID: ENST00000396871
  CDS Start-End: 428-1612
atttcccagcaggccctggggttagactggccgcagctggagaggtgccagcccgtcgtggatgactagagccaaccacctgccttccgtcttccaggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaa

SEQ ID NO: 201707 - DNA, 3348 bp, Homo sapiens
  Payload ID: 19797
  Gene Name: zinc finger protein 200
  Uniprot ID: P98182
  ENST ID: ENST00000431561
  CDS Start-End: 614-1801
gtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgagggcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaa

SEQ ID NO: 201708 - DNA, 3306 bp, Homo sapiens
  Payload ID: 19797
  Gene Name: zinc finger protein 200
  Uniprot ID: P98182
  ENST ID: ENST00000414144
  CDS Start-End: 552-1739
tttcccagcaggccctggggttagactggccgcagctggagaggtgccagcccgtcgtggatgactagagccaaccacctgccttccgtcttccaggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 201709 - DNA, 1350 bp, Homo sapiens
  Payload ID: 19797
  Gene Name: zinc finger protein 200
  Uniprot ID: P98182
  ENST ID: ENST00000575948
  CDS Start-End: 166-1350
gcgcctagtttttctatctctcccggagcctgagtctctgagccgtccccagcaaacgctcaggggctgcagaggccccgagagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaa

SEQ ID NO: 201710 - DNA, 713 bp, Homo sapiens
  Payload ID: 19797
  Gene Name: zinc finger protein 200
  ENST ID: ENST00000575617
  CDS Start-End: 585-713
gaaattgagaaaggaaaccgagacagtaggagaagggcaattaagatgtctttaaaaacaagacggccggtgcggacagcagtgtagaagttagcaagctggagtgggcaatgtcggtgccccatctctaacctatgggagtcaccagagcgggggcggagtcccatggcggccacaccctgtccgcctccgcagtctttttactggagaaccgcagtaaaaggcggaaaccgcggaggcgtcttgattttccggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccac

SEQ ID NO: 201711 - DNA, 4130 bp, Homo sapiens
  Payload ID: 19798
  Gene Name: zinc finger protein 202
  Uniprot ID: O95125
  ENST ID: ENST00000336139
  CDS Start-End: 364-2310
aaggccccacgtgttccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaaggttgtgggatagccttgggaggagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttcagtgtcctgatacttctgagggtggttcatactcaaatagatctgggagtacagagtatttttccttgaggaaaggaagggttgggatgattagcagagtccggtgaaacat

SEQ ID NO: 201712 - DNA, 855 bp, Homo sapiens
  Payload ID: 19798
  Gene Name: zinc finger protein 202
  ENST ID: ENST00000533463
  CDS Start-End: 477-855
gccccacgtgttccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaaggttgtgggatagccttgggaggagctataccctttttgtactctgtgtatatactatattgcagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaac

SEQ ID NO: 201713 - DNA, 552 bp, Homo sapiens
  Payload ID: 19798
  Gene Name: zinc finger protein 202
  ENST ID: ENST00000528306
  CDS Start-End: 416-552
gcaaaggccccacgtgttccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctccca

SEQ ID NO: 201714 - DNA, 3564 bp, Homo sapiens
  Payload ID: 19798
  Gene Name: zinc finger protein 202
  Uniprot ID: O95125
  ENST ID: ENST00000530393
  CDS Start-End: 401-2347
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgta

SEQ ID NO: 201715 - DNA, 3384 bp, Homo sapiens
  Payload ID: 19798
  Gene Name: zinc finger protein 202
  Uniprot ID: O95125
  ENST ID: ENST00000529691
  CDS Start-End: 221-2167
aaaggccccacgtgttccgacccgctaggccccgcgcggctcggatccggcggcgctgtttcggtcgggagtgggtgggagagaagccggggcaggggaggagccgccggagctgtcggagccggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgta

SEQ ID NO: 201716 - DNA, 564 bp, Homo sapiens
  Payload ID: 19798
  Gene Name: zinc finger protein 202
  ENST ID: ENST00000526252
  CDS Start-End: 534-564
gtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaaggttgtgggatagccttgggaggagctataccctttttgtactctgtgtatatactatattgcagtagacaatcattccaagggtacaacaaggtttaccacaatgtgagggactcagccattgcaaattgtacagatgaggggcttcacgttttgatcaaaatattacacctgtattctgggcttttgctgtgaattcctagtattgctaaaattctgcaatttcttaactacctgttaagttcctcaagggcccttggaagaaaatcctcgctgtgtccaggctgaggcggggggctaatgacagtgtgagctctagatggtgtgagaccaccccaaagccaagaaatggctacagccgtggaaccagaggaccagg

SEQ ID NO: 201717 - DNA, 1947 bp, Homo sapiens
  Payload ID: 19799
  Gene Name: zinc finger protein 205
  Uniprot ID: O95201
  ENST ID: ENST00000219091
  CDS Start-End: 125-1789
actcccagtctccacccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgcggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggc

SEQ ID NO: 201718 - DNA, 2062 bp, Homo sapiens
  Payload ID: 19799
  Gene Name: zinc finger protein 205
  Uniprot ID: O95201
  ENST ID: ENST00000382192
  CDS Start-End: 206-1870
tcctgtcttccctactcccagtctccacccaactcccccgcccgccccgtgcaggctgtggagactcccttcccgggggagggggcccccactgccgcaggtgccccctctgcctccaccccggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgcggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaa

SEQ ID NO: 201719 - DNA, 726 bp, Homo sapiens
  Payload ID: 19799
  Gene Name: zinc finger protein 205
  ENST ID: ENST00000444510
  CDS Start-End: 373-726
tgccccctctgcctccaccccggtgagaagggggtgctggggagggcatctggatcccgagaccggcgcagatgatcagcttgcaggaggggatggggtcaaaggtggaaggcttcaagctggcaggagagaagggggccaggaccgggtttgggaaggagaaggacattgtctgccaggaccgagagcaggatgggcatcccaggcctggggcaggtggttgcagctgcaggggggctgctgagagcgggcaggttgatttctgaattcctggtgggcatgggagtcaggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcc

SEQ ID NO: 201720 - DNA, 1006 bp, Homo sapiens
  Payload ID: 19799
  Gene Name: zinc finger protein 205
  ENST ID: ENST00000414351
  CDS Start-End: 171-1006
ggggccaggaccgggtttgggaaggagaaggacattgtctgccaggaccgagagcaggatgggcatcccaggcctggggcaggtggttgcagctgcaggggggctgctgagagcgggcaggttgatttctgaattcctggtgggcatgggagtcagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtccc

SEQ ID NO: 201721 - DNA, 766 bp, Homo sapiens
  Payload ID: 19799
  Gene Name: zinc finger protein 205
  ENST ID: ENST00000570935
  CDS Start-End: 1-766
ccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccc

SEQ ID NO: 201722 - DNA, 2309 bp, Homo sapiens
  Payload ID: 19799
  Gene Name: zinc finger protein 205
  Uniprot ID: O95201
  ENST ID: ENST00000620094
  CDS Start-End: 455-2119
agtctccacccaactcccccgcccgccccgtgcaggctgtggagactcccttcccgggggagggggcccccactgccgcaggtgccccctctgcctccaccccggtgagaagggggtgctggggagggcatctggatcccgagaccggcgcagatgatcagcttgcaggaggggatggggtcaaaggtggaaggcttcaagctggcaggagagaagggggccaggaccgggtttgggaaggagaaggacattgtctgccaggaccgagagcaggatgggcatcccaggcctggggcaggtggttgcagctgcaggggggctgctgagagcgggcaggttgatttctgaattcctggtgggcatgggagtcaggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgcggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttg

SEQ ID NO: 201723 - DNA, 2283 bp, Homo sapiens
  Payload ID: 19800
  Gene Name: zinc finger protein 207
  Uniprot ID: O43670
  ENST ID: ENST00000321233
  CDS Start-End: 155-1591
gggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagt

SEQ ID NO: 201724 - DNA, 1905 bp, Homo sapiens
  Payload ID: 19800
  Gene Name: zinc finger protein 207
  ENST ID: ENST00000342555
  CDS Start-End: 311-1804
gcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctgtgtgcatttgtaaatgttgaaatatttataacaaaagtttcaccgacatctctgttaaacacaggaatttgacaaagtatattgctgattattgagatgtgttttttggggtggtgaagagagctggccttctaggaaattgaaaatactgaaataacatggcaatgtcatcattaggctgtctttgtgccttaacagtattgatcaggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgacttt

SEQ ID NO: 201725 - DNA, 13781 bp, Homo sapiens
  Payload ID: 19800
  Gene Name: zinc finger protein 207
  Uniprot ID: O43670
  ENST ID: ENST00000394670
  CDS Start-End: 170-1654
accgcagtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttttgggatctgtttttctgatcttttgcagggtagttttatgattttttaggcatcaaataacctatgcaaagtattaatataatgaactcaagttgagtttttctcattataaagttaagacttctaagaaaatggtaacatttctttataactttcctgtgaaggtatagataaaacacatgaagtctgaagttgtatggaaaaaagggctttaactttgaaggaaaatatattgaaaagtgatttagccatcacaaaagagttcgtatttatgtgacagatgaaagtcatacctttaagcaaaacattgcaagtattataaagctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgattatctggcttcaatgattttggctcctgtgcttgtggtaccatagtggtacaaaaattttcatagtttgaaaataaaacaggtattttgccagtaatgtatttctttctgccagcagccaagtcccaaaccactttcccctctgaacctctgcttacctaaatggtttcaaaattaatacatgctgctttgatttggcagcacacttaatatactgctgaaggaaaacttgtgttgaaagtctttaagataaaaatggtgtgataggccgggcgcagtggctcacgcctgtaatcccagcactttgggaggcccaggcgggtggatcatgaggtcaggagatggagaccatcctggctaacacggtgaaaccccgtttctactaaaaatacaaaaaattagctgggcgtagttgcggatgcctgtagtcccaactactctggagaccgaggcaggagaatggcgtgaacccgggaggcatagcttgcagtgagcggagatcacaccactgcactctagcctggacgacagattgagactccgtctcaaaaaaaaaaaatgctgtgattaaatttagaataattaagtaaggggtgctctcccaaattctcaggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgaggcaagtgggatttattttattccttataggggctttcacagctttatggctgttggatatttatgtccccaaacttgcagcaagtttggtgaaggcccctaaatttaattaaacttaggatttttatactcttttggcagagaaggctctatattaatattcacgtttgactgtggtgttaataaacataagtatttcatatgcaattttatgtaatttgctgtgtgttacataattaacagcttcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactggatactgaaatgtgccttctcttttttgagacggagtttcactcttatcacccaggatggagtgcagtggtgcgatctcggttcactgcaacctctgcctcccggattcaagtgattctcctgcctcagcctcccgagtagctgggattataggctcccgccaccacatctggctattttttcaatatttttcagtagggatggggttttgccgtgttggccaggctggtctcaaactcctgacctcaggtgatccacccatctcagcctcccagagtgctggagtagcaggtgtgagccaccgcgcctggccaaaatctgcattctttttttttttttttttttttttttgagactgtctcgctgtgtcacccaggccagagtgcagtagcacgatctcagctcactacaacctccacctcctggattcaagcgattctcctgtctcagcctcccgagtagctgggactacaggtgcttgccaccacacccggctaattttttgtatttttagtagagacggggtttcaccgtgttagccaggatggtctcgatctcctgactttgcgatccccctgcctcggcctcccaaagtgctgggattacaggcgtgggccaccgcgcttggccaaaatctgcattcttaatcacaaacttacgcattgaatgttaaggctaaaaggtcatctggaaatgcttaattttaaaatattttcaagcctcaccacattagagcaaatgttaatgtagagccctgtaaaggtgggaaggtggtgtctatgtgtgtgcttgtgtatgtgggggtatagaccatatagttgatataacaacagaatttgggtgttacagacctttcagcatggatggattactaattttcaggtatcgaaactgaaatttgatacctgatcctgtggtaaagtatgttaaactatggttttggagtgattattttgaggttcattttcagcctcactgaacagtgttttacgcacatgtgaaaagtatccacatttgtttccaactaaaatttgcttttatttggtgagaaaagttgtgtgcgtgtgtttgttgtagggaataattagggaattggaagagaggccaaaaacaaacctgaattacttttgtttcttgtgtttgagccacgattctatccagatagcagtttactctgagcagtaacaatgaacaagcagtatagcatttagcaaacctggaattgtttgtatatggttttcattcttggaagcataaagaaaaaatatgcattaaatgaattgtaaattttgacttgttaaataacatgtttttcactataactaataggattttaatatttaaagaattttgttgcttccatgacaaaatatcccattggactattttataacctcagtaatcaacatttaagagtccttaattggagatctgttttctctattacctaccatcctgcaatatgctgaaatctttctaagttgcttatcttaattctaatggtgataattgaaaaaagtgtgctggaaatacaggctcttatctggttgagtactgggggtgggaaggatttagtaatgtcataatctgttgaaggtaatatctatagataactaagatagttcctttttttttgtagttctgtgactcagacaaataagattttgagaattatgtagtttttaggtgtctgtaacatccactagtaaaacttggcaaatgaaagaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataatggatattcattaattttgtgattagtgctgagttttctaaactactatcttaagctcttaggcaccctattatggatctaattcaaaccaatatgtaggaaatggagaaagtaggacttcagtttgcgcttcccaataactttaaatatatccaccttttccaagtgtttaagccctaaaacatctatctttatttttttacctggcatttttgttagaaaatagattacgttttaaagtaacattaaaaaaattcttcagtaagataattgcttttaataagtatatttttcttgctcttggctctatacatttttgcataatattttagtcttgaaaagcttttcattttcttaactctggaaaataatagtttggaactaaattagtttgagaaatctgaatcatctctctttaaatctgttcagttagtctcatgtattctcaggggaaaatgtctttattttactaagcggaagtagtagtcatattgaggcagaaatttgtagcccaaacaaggtaggtcttcgctgaaactaatttgaactattcctatttgaagcaaattgaacactattataaatctagactggctaattagatggaaactttgatggttaggttctttaagaggcatacaatccgttatgagaatgtttatgtttatgttttaatttttatcaaaataacctcagaggaggtacatgtgagtaaactgtcttaatggttgattacttggaacccacccattaattctaaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttcaccattggttaagtctgaggaactaacagtgaaattcattgatggccaacttggataaaaatgaagaatgatattttcccagtttactacacatggaccaatagtgattatttgggagagaacactgggtagtattgtttgacttaagaaccttaaatatattgaaaagtaatggcattcttgctcatgatttgcatttgttagtgaggtctcaccatagtattttaatgtagcttcttattaaaattttattcataaatagtttagcagtcacagaggtgaaaaaaaaaagatttgcaccatcatatccgagtctttactaataaaatgaggctgcttaagtacccaagtggagcaagggaagagttactacagttactgtaagtctgagttagaaaaaatacagagcatctagttattgagcaaagcccccttttacctgttcgcttattcaaagagaaacaatagaatttgcttctcagtacatgtttttaaaattgagaatctctgatgtgacaaaatcaatttttacaaaagttgaattaaaaacttttaaaaattgcttgtctttgggggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaactagggaaaagttttaaatgtattagtatcaggctctgaggaaatttaatgcacattgactttttaaactatggattgaactcctcagtttaatacaatttgtgtttttgttaactagcagcagaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttat

SEQ ID NO: 201726 - DNA, 2124 bp, Homo sapiens
  Payload ID: 19800
  Gene Name: zinc finger protein 207
  Uniprot ID: O43670
  ENST ID: ENST00000394673
  CDS Start-End: 149-1540
cggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatt

SEQ ID NO: 201727 - DNA, 847 bp, Homo sapiens
  Payload ID: 19800
  Gene Name: zinc finger protein 207
  ENST ID: ENST00000394679
  CDS Start-End: 253-847
gggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctgagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccac

SEQ ID NO: 201728 - DNA, 572 bp, Homo sapiens
  Payload ID: 19800
  Gene Name: zinc finger protein 207
  ENST ID: ENST00000580759
  CDS Start-End: 294-572
ttttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctgtattgatcaggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactg

SEQ ID NO: 201729 - DNA, 592 bp, Homo sapiens
  Payload ID: 19800
  Gene Name: zinc finger protein 207
  ENST ID: ENST00000582165
  CDS Start-End: 306-592
gacgtggtggtagccgttgggttgggaaagtgagggatttttggcctcgtttctcctgcttcttttctcctcccttttactttgccggtagaacacagttatgggtcgcaagaagaagaagcagctgaagccgtggtgctgtgtcatcattaggctgtctttgtgccttaacagtattgatcaggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagt

SEQ ID NO: 201730 - DNA, 3560 bp, Homo sapiens
  Payload ID: 19800
  Gene Name: zinc finger protein 207
  ENST ID: ENST00000581531
  CDS Start-End: 1-1025
caggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaatagccctgccataggacaggctgaggctgagtctcagtgttgccctgttcagtctgaggcaaaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacatacctta

SEQ ID NO: 201731 - DNA, 580 bp, Homo sapiens
  Payload ID: 19800
  Gene Name: zinc finger protein 207
  ENST ID: ENST00000579634
  CDS Start-End: 358-580
attttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtatcctttgtcggtttgaagtcgaggcagtgtcatcattaggctgtctttgtgccttaacagtattgatcaggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagc

SEQ ID NO: 201732 - DNA, 4672 bp, Homo sapiens
  Payload ID: 19800
  Gene Name: zinc finger protein 207
  ENST ID: ENST00000577908
  CDS Start-End: 107-1588
ctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaagccctgccataggacaggctgaggctgagtctcagtgttgccctgttcagtctgaggcaaaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctc

SEQ ID NO: 201733 - DNA, 580 bp, Homo sapiens
  Payload ID: 19800
  Gene Name: zinc finger protein 207
  ENST ID: ENST00000578918
  CDS Start-End: 443-580
aatcttcaggaagcgttctcacagggcggagtttctgttacccaactttgtaggactaaaaagtgcctatcttattaggaaaactcttactacagtgtggtattaatgctttttctggaagcgttaatattctttacattaaaattgattttatttactgttttgtacgtaaaggcggcttgttacagtactgcgtttatgtaacagttttaaaaatagcttaaatacggttacgaattttgtaatgtgattttaggaaaatctgagtagtgaggcagtgtcatcattaggctgtctttgtgccttaacagtattgatcaggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaa

SEQ ID NO: 201734 - DNA, 3992 bp, Homo sapiens
  Payload ID: 19801
  Gene Name: zinc finger protein 208
  Uniprot ID: O43345
  ENST ID: ENST00000397126
  CDS Start-End: 150-3992
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttagtatgttctcaatccttactaaacataaggtaattcataatggagagaaaccctacaaatgtgaagaatgtgataaggcaactcatgctggagagaaaccctacaaatgtgaagaatgtggcaaagctttcaactggtcctcaaaccttatggaacataagagaattcatactggagagaaaccctacaaatgtgaagaatgtggcaaaagcttcagtacattctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataagtcatcctcaacccttagttatcataagaaaattcatactgaagagaaaccttacaaatatgaagaatgtggcaaaggctttagtacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagagaaactctag

SEQ ID NO: 201735 - DNA, 740 bp, Homo sapiens
  Payload ID: 19801
  Gene Name: zinc finger protein 208
  ENST ID: ENST00000599916
  CDS Start-End: 156-539
gtcggtcctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaagatacaagattcatcatcatgcctgtgagctgggtccaataatgaatcaccatcctacttgtggccaaatgcatatatgacagttacaactctaactgcagactgcatcggcatgtaaaatttaggtcaccagtgggctctctccatgtttgaatgtggtgattctaatggtcagcgaggtgtgcataggagagtcacaatctcatcttcaggtgggccttgtatcagcactctctctactaccttaagactgtatgacacatgggtgagctaaaaatgtt

SEQ ID NO: 201736 - DNA, 2027 bp, Homo sapiens
  Payload ID: 19801
  Gene Name: zinc finger protein 208
  ENST ID: ENST00000601773
  CDS Start-End: 150-488
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagggatggtgggatccagtggaccagaatcgtcagcaccttaccatgttcactgctgtcctttcgttctgtcactaagattagtttccgagactcatcaactctttctatcatgatgtgaactgttttgcactgcgttagcgtctgcctttggtttctgctaattttctttgactttcatttttcttgtccttctctggtgtttgctttgctgctccactttgaggagtttgggcagcttcaccctcagccgctccagcagttcctccatttggctgaagctctccgttcttctgttcttggcgtctgacatttgtcagcaaggcctggtttacagggaccacggctaccgcctcctctgcggggcacctccttcacttccggagggcgccagttccagtcgtgacccagctgagcacagcaggaaccgccgcagcagccggagcgcccacgcccacggtcgcccagcccggggatgcctcggctcaaagccggggtcgcggctcagcttagtgcgcagaaatccgaggtcaaccagagcatttcccacagctggccgagccctcctcgacctgcggggccagtttctcccactggctttctgctgccacctccccttccatcagagggacgctcaggattgtgcaggggcccgtagacaccgtgaggagtccagggaagtgaggaggggctgggccgggcaggctcaagcccagcgcacggccgcacccctcacgcctgagcagagatcagccactgccaccgcggggaggacagagggacccaggatcccccagccagcctccctctgcgtcaggagaggagggaactatttccaaaatatatatagagagagagagtagaactggcatatctgacccaatcgagttttcagtttttcttttctttttcgccttttcctctcaaattatgctcgcctaaagtgagagttcatttttcattctcacgtggcaatttaattttttaatggtcacaaacttagagactaaaatttttactctattttacctaagaatgatgaggtaacatcaaacttttaatagtgctttctgaattttacagtttattaccttagatttgattctatcaactaaacaataataactaaaaaagtcttggtttgcatagcttgaccatttacaaaggggatgtatttattcatttaaatgataaatgtgtgttgagcacacacgttgtgccatacttcttgctagctttaggagataaaatggagaaaaaaaatattgctctttactcttataaaactttcagtcttgctacataaaattggccaggttgttctcgaactccccacctcgtgatctgccacctcagcctcccaaagtggtgggattacaggtatgagccaccccaccgagcctctcctagaagttttaaatcctcgatatacatgaacaatttttgtgttagttgctttgcaaggatccaatctacctaggtagaaccaatagtttagctattagtttattgactagttctgcttttccagtataattgtgtaactgatttctcattttaacctgttggctgaaaccatggatgcaatgtttaataaaaatcttgaacaccaacataattattatgtttatgacattaaaagacaaactttcagt

SEQ ID NO: 201737 - DNA, 536 bp, Homo sapiens
  Payload ID: 19801
  Gene Name: zinc finger protein 208
  ENST ID: ENST00000601993
  CDS Start-End: 422-536
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgatggagtttcactcttgttgcccaagctggagtgcaatggcatgatctcggctaaccgcaacctctgcctcgcgggttcaagcgattctcctgcctcagcctcctgagtagctaggattacaggcatgcgccaccatgcctggctaattttgtgtttttagtggagacagggtttctccatgtttgtcaggctggtctcgaactcccgacctcaggtgatctgcctgcctcagcctcccaaagtgctaggattacaggcataagccaccatgcctggcacacaattaattctgtatgatggatcattgacatttagggatgtggccatagaattctctctggaggagtggcaatgcctggacactgcacagcagaatttatata

SEQ ID NO: 201738 - DNA, 781 bp, Homo sapiens
  Payload ID: 19801
  Gene Name: zinc finger protein 208
  ENST ID: ENST00000597040
  CDS Start-End: 316-471
ggtcaaggtctcgtccttactgctgtgtgtcctctgctcctagagtcccagcctctgtggccctatgacctgcaggtattgggagatccacaactaagtcgccaggaccccctggaagcctagaaatgggacggggtttcaccatgttggtcaggctggtctcgaactcctgatttcaagtgattcacctgcttcggcctcccaaagtgctgggattacaggggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccaggggcatcttcggtcttacacttttaaaatttctaagaattcttctttcccttcagtaatcttccttcaagtttacagtgacagccaaagtactgttcatggcatacaagagagtgcacaatctttttgtttgtttgtttttgtggacacacagatatctgcatgattttaagatactccatgttaaactatcttataagttctctctttccatcatctctgaaatgtgtgagagtagtagtttctgtatctttggggtttttttgttcatttttctgtacatttcatcctgtttttattactgtagtcttgaaatatagtttgaaattataaagta

SEQ ID NO: 201739 - DNA, 710 bp, Homo sapiens
  Payload ID: 19801
  Gene Name: zinc finger protein 208
  ENST ID: ENST00000599723
  CDS Start-End: 1-230
gatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccaggtaggtgagagtgaatacagacaacatggatgagaggtcgaaagtcaaggaggaagccagtccttaaagtgattctggaagctgtgttccaaaagaagtagtttctggagagactaatttttatttttattctttaattttctctcacacaggggcatcttcggtcttacacttttaaaatttctaagaattcttctttcccttcagtaatcttccttcaagtttacagtgacagccaaagtactgttcatggcatacaagagagtgcacaatctttttgtttgtttgtttttgtggacacacagatatctgcatgattttaagatactccatgttaaactatcttataagttctctctttccatcatctctgaaatgtgtgagagtagtagtttctgtatctttggggtttttttgttcatttttctgtacatttcatcctgtttttattactgtagtcttgaaatatagtttgaaattataaagta

SEQ ID NO: 201740 - DNA, 3653 bp, Homo sapiens
  Payload ID: 19801
  Gene Name: zinc finger protein 208
  ENST ID: ENST00000609966
  CDS Start-End: 150-3653
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttaagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataatacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagttcccaaccctcctacacataagaaaattcatgctggagagaaactctacaaatga

SEQ ID NO: 201741 - DNA, 2440 bp, Homo sapiens
  Payload ID: 19802
  Gene Name: zinc finger protein 211
  Uniprot ID: Q13398
  ENST ID: ENST00000240731
  CDS Start-End: 120-1853
ctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagcta

SEQ ID NO: 201742 - DNA, 1959 bp, Homo sapiens
  Payload ID: 19802
  Gene Name: zinc finger protein 211
  Uniprot ID: Q13398
  ENST ID: ENST00000254182
  CDS Start-End: 194-1861
tcttcgcagcggtcattttggctgccctcccggaggtccgttctgtctgtcagccgctttggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaa

SEQ ID NO: 201743 - DNA, 2577 bp, Homo sapiens
  Payload ID: 19802
  Gene Name: zinc finger protein 211
  Uniprot ID: Q13398
  ENST ID: ENST00000299871
  CDS Start-End: 132-2021
cggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttt

SEQ ID NO: 201744 - DNA, 2472 bp, Homo sapiens
  Payload ID: 19802
  Gene Name: zinc finger protein 211
  Uniprot ID: Q13398
  ENST ID: ENST00000347302
  CDS Start-End: 180-1874
agggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttg

SEQ ID NO: 201745 - DNA, 2239 bp, Homo sapiens
  Payload ID: 19802
  Gene Name: zinc finger protein 211
  Uniprot ID: Q13398
  ENST ID: ENST00000391703
  CDS Start-End: 142-1653
cattttggctgccctcccggaggtccgttctgtctgtcagccgctttgggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagct

SEQ ID NO: 201746 - DNA, 1750 bp, Homo sapiens
  Payload ID: 19802
  Gene Name: zinc finger protein 211
  ENST ID: ENST00000407202
  CDS Start-End: 1-1705
gatctcggcttactgcaacctccacctcctgggttcaagcgattctcctgcctcagcctcccaagtagctgggactacaggcatgcgccaccacgcccagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaa

SEQ ID NO: 201747 - DNA, 2759 bp, Homo sapiens
  Payload ID: 19802
  Gene Name: zinc finger protein 211
  ENST ID: ENST00000540556
  CDS Start-End: 167-283
tggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggctgttcagtggaagaaaagactttagagatggatgaggacgttgaggcagagggaggttgaatatttttccaaggccacacaactggtgagaggcagcactaaggaccgaggcgcacaggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaa

SEQ ID NO: 201748 - DNA, 2629 bp, Homo sapiens
  Payload ID: 19802
  Gene Name: zinc finger protein 211
  ENST ID: ENST00000541801
  CDS Start-End: 181-2031
cagggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttg

SEQ ID NO: 201749 - DNA, 2641 bp, Homo sapiens
  Payload ID: 19802
  Gene Name: zinc finger protein 211
  ENST ID: ENST00000535785
  CDS Start-End: 132-269
cggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggccgtgggagccatagagagcttgcgcaaacgagagacaccatctgagttaaatttgaaaaatcctctgcaggctgttcagtggaagaaaagactttagagatggatgaggacgttgaggcagagggaggttgaatatttttccaaggccacacaactggtgagaggcagcactaaggaccgaggcgcacaggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaa

SEQ ID NO: 201750 - DNA, 2810 bp, Homo sapiens
  Payload ID: 19803
  Gene Name: zinc finger protein 212
  Uniprot ID: Q9UDV6
  ENST ID: ENST00000335870
  CDS Start-End: 129-1616
agaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagtt

SEQ ID NO: 201751 - DNA, 860 bp, Homo sapiens
  Payload ID: 19803
  Gene Name: zinc finger protein 212
  ENST ID: ENST00000462724
  CDS Start-End: 86-238
caacaggctctggggcgccgagcggacaggaacgcagcacgggggctccgaggcggggtctgggtgttgaggggcgactggagccatggcggagtcggcgcctgctcgggtaaagaggcaccggcgcgctggctcgagggcgcgttggggatggcggagtcccctgccgggggcggggcttcgcggtttggacgccgccggggtcttggtttcccggggctgccgttggcgcgggtgaacgcggaccctcctcttcgcgaccccagtgctctgcccttttttccctccgcttccttctgcagcggggtcggagcctcggcgccgtgcgcccttgcccagaaacttctctgacgcttgctttaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgaga

SEQ ID NO: 201752 - DNA, 637 bp, Homo sapiens
  Payload ID: 19803
  Gene Name: zinc finger protein 212
  ENST ID: ENST00000486371
  CDS Start-End: 118-270
ggcatcaacacggcggcggcggcggcggcttccaacaggctctggggcgccgagcggacaggaacgcagcacgggggctccgaggcggggtctgggtgttgaggggcgactggagccatggcggagtcggcgcctgctcgggtaaagaggcaccggcgcgctggctcgagggcgcgttggggatggcggagtcccctgccgggggcggggcttcgcggtttggacgccgccggggtcttggtttcccggggctgccgttggcgcgggtgaacgcggaccctcctcttcgcgaccccagtgctctgcccttttttccctccgcttccttctgcagcggggtcggagcctcggcgccgtgcgcccttgcccagaaacttctctgacgcttgctttagcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaacca

SEQ ID NO: 201753 - DNA, 559 bp, Homo sapiens
  Payload ID: 19803
  Gene Name: zinc finger protein 212
  ENST ID: ENST00000488917
  CDS Start-End: 1-208
ctgtttcaccgagcaggaatgggagaatctggaggattggcagaaggagctctacagaaacgtgatggagagtaactatgagacactggtctctctgaagtcttgctctattgcccaggctggagtgcagtggcacaatcttggctcactgcaacctctgcctcacaggttcaagcgattctcctgcctcagcctctcgagtagctgaaattacagaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggca

SEQ ID NO: 201754 - DNA, 581 bp, Homo sapiens
  Payload ID: 19803
  Gene Name: zinc finger protein 212
  ENST ID: ENST00000481584
  CDS Start-End: 1-581
gtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgagttcaagcgattctcctgcctcagcctctcgagtagctgaaattacagaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagca

SEQ ID NO: 201755 - DNA, 3313 bp, Homo sapiens
  Payload ID: 19804
  Gene Name: zinc finger protein 213
  Uniprot ID: O14771
  ENST ID: ENST00000396878
  CDS Start-End: 476-1855
cgaggacttccggcgccgggagctcgcggcggaagtgggatctcctgggccgtagtgggcgttgtgtgtttcgggggcgggggcgggggcgggggccggggcggggacggggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaacttac

SEQ ID NO: 201756 - DNA, 2996 bp, Homo sapiens
  Payload ID: 19804
  Gene Name: zinc finger protein 213
  Uniprot ID: O14771
  ENST ID: ENST00000416391
  CDS Start-End: 366-1745
ggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcact

SEQ ID NO: 201757 - DNA, 2240 bp, Homo sapiens
  Payload ID: 19804
  Gene Name: zinc finger protein 213
  Uniprot ID: O14771
  ENST ID: ENST00000576416
  CDS Start-End: 429-1808
gacggggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggtgagtcctggccctcttcgaggaaagtcttcttcgaagtcaccagaggatgagaatggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagt

SEQ ID NO: 201758 - DNA, 1368 bp, Homo sapiens
  Payload ID: 19804
  Gene Name: zinc finger protein 213
  ENST ID: ENST00000572647
  CDS Start-End: 1-549
gaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaac

SEQ ID NO: 201759 - DNA, 821 bp, Homo sapiens
  Payload ID: 19804
  Gene Name: zinc finger protein 213
  ENST ID: ENST00000574575
  CDS Start-End: 1-813
cagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctgg

SEQ ID NO: 201760 - DNA, 549 bp, Homo sapiens
  Payload ID: 19804
  Gene Name: zinc finger protein 213
  ENST ID: ENST00000573771
  CDS Start-End: 396-549
atttcacagagcaggcaacgcaggagctgggacgtaatcaataactagcacaggtttatattatgattcgtctgtagcggcctgccaaaggttccatataacatccctgcggcaggaactgacacttcaggccccaccgaatcagctagataacggcccacattgcagagcagccaatcaaaaccggaacatatttagatcatttggtaaacgggacactcaagcagtcctatagggaggcctatgtggggaggaactgaggtctcctgccaagagccacgagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattct

SEQ ID NO: 201761 - DNA, 3208 bp, Homo sapiens
  Payload ID: 19804
  Gene Name: zinc finger protein 213
  Uniprot ID: O14771
  ENST ID: ENST00000574902
  CDS Start-End: 373-1752
ttcctgttcattggccatcggtcatggagaaggcgggctcagtggacgaacggctttctgggagctggggaatgcttgcgtagcgtagtttcccagcgagccccgcgaggacttccggcgccgggagctcgcggcggaagtgggatctcctgggccgtagtgggcgttgtgtgtttcgggggcgggggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaactt

SEQ ID NO: 201762 - DNA, 3245 bp, Homo sapiens
  Payload ID: 19804
  Gene Name: zinc finger protein 213
  ENST ID: ENST00000576863
  CDS Start-End: 345-782
aacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacagggagtaaactctgtctcccccggtctggtctcgggctgatgagcatgttgtggttcctgcacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaactta

SEQ ID NO: 201763 - DNA, 2681 bp, Homo sapiens
  Payload ID: 19805
  Gene Name: zinc finger protein 214
  Uniprot ID: Q9UL59
  ENST ID: ENST00000278314
  CDS Start-End: 317-2137
gagtgtctactccaagacctgggacttccgtttcggtccagccgggctgcggccattgtttgtgtggactgagtgttttggccatcccggtccactctcacaggctccgttaagtgacatgaactctcaggaggactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaagaaagcctgatctttgaccagatggcagtaacatttgaagatgtgactattatttttacatgggaggagtggaaattcctggattcttctcaaaaaagactctacagggaggtcatgtgggagaactacacaaatgtcatgtcagtagaaaactggaatgagagctacaaatcccaagaagaaaaattcagatacttagaatatgaaaatttttcctactggcaaggctggtggaatgctggcgcccagatgtatgagaatcagaactatggggaaactgttcaagggacagattccaaagacctcacacagcaagatcgttcccagtgtcaggaatggttaatactctccacacaagtaccagggtatgggaactatgaactgacttttgaaagcaaaagtctcaggaacttaaaatataaaaattttatgccttggcagtccttagaaacaaaaaccactcaagactatggtagagaaatctacatgagtggttcacatggttttcaagggggcagataccgtcttggcatatccaggaaaaacctctccatggaaaaagaacagaagctcatagttcagcattcttatatcccagtggaggaagcccttccacagtatgttggggtgatatgtcaagaagacctactgagagattcaatggaagaaaagtactgtggatgtaataaatgtaaaggaatttattattggaactcacggtgtgttttccacaagagaaatcaacctggagaaaacctctgtcaatgctccatctgtaaagcatgcttctctcagagatcagacttgtatagacatccaagaaaccacataggtaagaagctgtacggatgtgatgaagttgacggtaactttcatcagagctccggagttcactttcatcagagagttcacataggggaggtaccttatagctgtaatgcatgtggtaagagcttcagccagatctctagtcttcacaatcatcaaagagtccacacagaagagaaattctataaaattgagtgtgataaagacctcagtagaaattcattacttcacattcaccagagacttcacataggagagaagccttttaaatgtaatcagtgtggtaagagttttaatcggagttcagtacttcatgttcatcagagagtccacacaggagaaaaaccatataagtgtgatgagtgtggtaagggtttcagccagagctcaaatcttcgaattcatcagttagtacacacaggagagaagtcttataaatgtgaagactgtggtaaaggctttacccagcgctcaaatcttcaaattcatcagagagtgcatacaggagagaaaccttataaatgtgatgactgtggaaaggactttagtcacagctcagatcttcgcattcatcagagagtccatacaggggagaaaccctatacttgtcctgaatgtgggaagggcttcagtaagagttcaaagcttcacactcatcaaagagtacatactggagagaaaccctacaaatgtgaagagtgtggcaagggattcagtcagcgttcacatcttctcattcatcagagagtccatacaggagaaaagccctataaatgtcatgattgtggaaagggttttagtcacagttctaatcttcacattcatcagagggtccatacaggagagaagccttatcaatgtgctaagtgtggtaaaggtttcagtcatagctcagctcttcgaattcatcaaagagtccatgcaggagagaaaccttacaaatgccgtgaatattataagggatttgatcataattcacatcttcacaataatcatagaagaggaaacttataaatattgttcatttagttaacagctttaatcaaagtttacctaacctttaaaccctataaatcctgctgttaaggaaatcttataaataacacaagtaatcccaagcaacatttatagtttcccctatctcccactaagaattatttgcttcaaaaggagatctttagaaaaaaccctatatatttaaaattatagtgtatttttctttacctactataaatataatacagtcataaatatattaaacatttaaggagaaaactcttcattctatttcattctagtctttttttctgtgcattttaatgtgcatgaaattgtgtgttcaattttgtattttcactgtcttcaaaatatttacttaaattttggtttgaattgaaactggttggccaactgttaaacgacatctcttaactcccctaaaaactccctaggaagtaacagaaaagatggaaacacatagaacttaaaactcagttttggccggtagaattcaattgtttatggacaaaagccacctaataaaagataggaaagcatt

SEQ ID NO: 201764 - DNA, 2562 bp, Homo sapiens
  Payload ID: 19805
  Gene Name: zinc finger protein 214
  Uniprot ID: Q9UL59
  ENST ID: ENST00000536068
  CDS Start-End: 243-2063
gactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaaggaacctacctttgatcagcaaggaaggactggggtggcaaaggctcatgcccccattttacagcctgatctttgaccagatggcagtaacatttgaagatgtgactattatttttacatgggaggagtggaaattcctggattcttctcaaaaaagactctacagggaggtcatgtgggagaactacacaaatgtcatgtcagtagaaaactggaatgagagctacaaatcccaagaagaaaaattcagatacttagaatatgaaaatttttcctactggcaaggctggtggaatgctggcgcccagatgtatgagaatcagaactatggggaaactgttcaagggacagattccaaagacctcacacagcaagatcgttcccagtgtcaggaatggttaatactctccacacaagtaccagggtatgggaactatgaactgacttttgaaagcaaaagtctcaggaacttaaaatataaaaattttatgccttggcagtccttagaaacaaaaaccactcaagactatggtagagaaatctacatgagtggttcacatggttttcaagggggcagataccgtcttggcatatccaggaaaaacctctccatggaaaaagaacagaagctcatagttcagcattcttatatcccagtggaggaagcccttccacagtatgttggggtgatatgtcaagaagacctactgagagattcaatggaagaaaagtactgtggatgtaataaatgtaaaggaatttattattggaactcacggtgtgttttccacaagagaaatcaacctggagaaaacctctgtcaatgctccatctgtaaagcatgcttctctcagagatcagacttgtatagacatccaagaaaccacataggtaagaagctgtacggatgtgatgaagttgacggtaactttcatcagagctccggagttcactttcatcagagagttcacataggggaggtaccttatagctgtaatgcatgtggtaagagcttcagccagatctctagtcttcacaatcatcaaagagtccacacagaagagaaattctataaaattgagtgtgataaagacctcagtagaaattcattacttcacattcaccagagacttcacataggagagaagccttttaaatgtaatcagtgtggtaagagttttaatcggagttcagtacttcatgttcatcagagagtccacacaggagaaaaaccatataagtgtgatgagtgtggtaagggtttcagccagagctcaaatcttcgaattcatcagttagtacacacaggagagaagtcttataaatgtgaagactgtggtaaaggctttacccagcgctcaaatcttcaaattcatcagagagtgcatacaggagagaaaccttataaatgtgatgactgtggaaaggactttagtcacagctcagatcttcgcattcatcagagagtccatacaggggagaaaccctatacttgtcctgaatgtgggaagggcttcagtaagagttcaaagcttcacactcatcaaagagtacatactggagagaaaccctacaaatgtgaagagtgtggcaagggattcagtcagcgttcacatcttctcattcatcagagagtccatacaggagaaaagccctataaatgtcatgattgtggaaagggttttagtcacagttctaatcttcacattcatcagagggtccatacaggagagaagccttatcaatgtgctaagtgtggtaaaggtttcagtcatagctcagctcttcgaattcatcaaagagtccatgcaggagagaaaccttacaaatgccgtgaatattataagggatttgatcataattcacatcttcacaataatcatagaagaggaaacttataaatattgttcatttagttaacagctttaatcaaagtttacctaacctttaaaccctataaatcctgctgttaaggaaatcttataaataacacaagtaatcccaagcaacatttatagtttcccctatctcccactaagaattatttgcttcaaaaggagatctttagaaaaaaccctatatatttaaaattatagtgtatttttctttacctactataaatataatacagtcataaatatattaaacatttaaggagaaaactcttcattctatttcattctagtctttttttctgtgcattttaatgtgcatgaaattgtgtgttcaattttgtattttcactgtcttcaaaatatttacttaaattttggtttgaattgaaactggttggccaactgttaaacgacatctcttaactcccctaaaaactccctaggaagtaacagaaaagatggaaacacatagaacttaaaactcagttttggccggtagaattca

SEQ ID NO: 201765 - DNA, 3448 bp, Homo sapiens
  Payload ID: 19806
  Gene Name: zinc finger protein 215
  Uniprot ID: Q9UL58
  ENST ID: ENST00000278319
  CDS Start-End: 589-2142
tgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaagtgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaatataatgtaagaaaacatttgtcagatttttctttaaatgatatcacagaattaatgttggatagaaatatcattggatagaaatctgtttgaaggaattttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattaggcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactct

SEQ ID NO: 201766 - DNA, 3257 bp, Homo sapiens
  Payload ID: 19806
  Gene Name: zinc finger protein 215
  Uniprot ID: Q9UL58
  ENST ID: ENST00000414517
  CDS Start-End: 387-1940
agagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacggttgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaagtgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaatataatgtaagaaaacatttgtcagatttttctttaaatgatatcacagaattaatgttggatagaaatatcattggatagaaatctgtttgaaggaattttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattaggcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactctgtacaccagaa

SEQ ID NO: 201767 - DNA, 1396 bp, Homo sapiens
  Payload ID: 19806
  Gene Name: zinc finger protein 215
  Uniprot ID: Q9UL58
  ENST ID: ENST00000529903
  CDS Start-End: 88-1002
tagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaagatggagtttccctcttgttgcccaggctggagtataatgatgcagtctcggctcactgcaacctccacctctgggttcaagtgattctcctgcctcagcctcctgagtagctgggattagaggcacccaccaccatgcctagctaattttttgtgtttctagtagaaatggggtttcaccatgttggccaggctggtcttgaactcctgacctcaagtgatccgcccacctcagcctcctaaagtgctgggatgacaggcgtgagccaccacgcccagctgtcccttaacatttgaaatgtgtatatcacctcatttagctattctgtttctagaaacttatttttacaaagaaaattcacaaatgcacacgaaaatgtatgcatgaagatacttgtcacagcgttggttgtaataatatggaattaggtcaaatatttatcagtaaaagactaagtcatattgtgcatatactgaaatatgtgataaacctaaatttactgac

SEQ ID NO: 201768 - DNA, 1503 bp, Homo sapiens
  Payload ID: 19806
  Gene Name: zinc finger protein 215
  Uniprot ID: Q9UL58
  ENST ID: ENST00000610573
  CDS Start-End: 589-1503
tgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaagatggagtttccctcttgttgcccaggctggagtataatgatgcagtctcggctcactgcaacctccacctctgggttcaagtgattctcctgcctcagcctcctgagtag

SEQ ID NO: 201769 - DNA, 5633 bp, Homo sapiens
  Payload ID: 19807
  Gene Name: zinc finger protein 217
  Uniprot ID: O75362
  ENST ID: ENST00000302342
  CDS Start-End: 272-3418
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgc

SEQ ID NO: 201770 - DNA, 5796 bp, Homo sapiens
  Payload ID: 19807
  Gene Name: zinc finger protein 217
  Uniprot ID: O75362
  ENST ID: ENST00000371471
  CDS Start-End: 427-3573
attcaaacccggccggcccgagtggtgtcagctcagtcccggccgccgccgcgcgaggaaatggccgaggagccggagccgcagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttga

SEQ ID NO: 201771 - DNA, 746 bp, Homo sapiens
  Payload ID: 19807
  Gene Name: zinc finger protein 217
  ENST ID: ENST00000437222
  CDS Start-End: 1-450
ggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaat

SEQ ID NO: 201772 - DNA, 779 bp, Homo sapiens
  Payload ID: 19807
  Gene Name: zinc finger protein 217
  ENST ID: ENST00000431687
  CDS Start-End: 495-779
accgttttaaggcttcatggtgatgagggcatttaaccctcgggacacgcccattctgcaggcctggctcgacctccactttggagaagatgctccaggaacactgaagggcaggtcgtccccgaccttctatgaggattgcccagctcaagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaacca
